United States Patent 10,767,156 (POLYNUCLEOTIDES ENCODING BREX SYSTEM POLYPEPTIDES AND METHODS OF USING SAME) - sequence listing, part 15

SEQ ID NO: 6222 - DNA, 3544738 bp, Methanospirillum hungatei JF-1 (residues 1-1,772,369 of 3,544,738)
tcacggctgcacataccgtgataggaaagccctatcgacctatatatcccgagtttccaaagaccagtgccagggtttcaaagatcctggtgaaaaacatgcataatccggttttacggatgacagatccggatatccggttgaagatgtgcgtggttttggtgaagaaaaagacggagatccggtttgttttccatgagcgatcatttcagtttcctgcattctttggaacatatcacgacaaagctcgtggtactacgtactgattggagtgaaacaggccctctttcctgtttccatgcacatattcatctgtacatgcccccatgagaatatgtacactgatatccgatcaggactgaactggaggctgactaataatatctatccctgatggataagcatttgcatttcaattctgccatgcattgcagaattacatgtaatatttttcggacgagagtgagagtgtgaagagtacaaaaaaagtagaatgatctcgtactatacccggtaccggggggaaggagcactcatggcaagggagatccctttttgaatgcatgaaagcccctcttcctggtacccggtctttcgaagagtcattcctttattgtaccaaacttctgcattgttcggatcagattcgagtgccttatcataccagaccagtgcatctgcatggtttcccatatgatccaggcaatctgcaaccttttgaaatgcccgcccattattcggctctttttcaataatctctttgtaaagcctgattgcgatctcatactcaccccttatctgacattcatcagcagcacaaaaaactgattcaatcaagggatcgattgtcgcatacattcgttcaaaagctgacgttccctctgttgacatgtgtatcctgtcctaaaaacaaagaccggtaaaaataccccaagacgctcgtcacacacacatttaagactcccttttacctttcccggtctttggcctgcaaccagaatattcagatgatacatatcagatccatacggcgattctcttgtccggtaaagaactgacctatgcattgaatgttcatcatttatgggatagtacttgaggtaatttccatttagagagtatattgataaggatatgccattcagatatgcacgtcagtaatgccatgcaataaaacaaaaacagggaattatgataggcaaataaaaatttcccccacataaaaggatatttacgagggagatccggacacgggatcagagctcagcggcgattttttcgatcatggtcctgatatcaagccagacaaccagtccgcttttatccttctcaccggttgtttttgtcttcttcctgatgacacccagaatgtcccggtgagtcttctgcgatgatgtattctccttgtcgatatcttcattgccataagttgtaacagagaagacatcatccacgaggatgccgattggcttttctgttatcgaacgatcaagcacgatgatccgggattttttcttccccgatgattcggtggtgatatgcatgagatctttcaggtcaatgatggtggttatcattccccgaaggtctatgataccctttagataaggaggggtgtttgggagcggagttacttcggtctgggtgatcacctccctggtatcaaagagatcaattgcaaagagttcattaccaaggatgaattcaacgacctggatggtccctgccccctttgtcctgatccgtgacgttgtctgaacgggagcctgtattgcaggtccttcctcatcaaaggctgcctgggcctcaacactataggttgccatgatatatcctctcctgatacttggtttattcattcataaacttacccctgtcggttggcatacagggaaaatggacataccagaggcaggtaaataaatcctgaatcaaccggatttaagtaatcaggccgcaattgaagcgacctcacaggattatacagtgcactacgaaaattccttattataacaggacataaacctcatcaattatcccacggtcacgaaatatatgcatacctcctcacgcacctcatcagatattttaaaaatactccttgttgatgacgaggatgtggttctgcatgctacccgtgagtatctgaagacatgtttctcttttgatgttgatattgcagtatcaggatcctccgcccttgccagactttcagaaaacgagtacgatgccatcattgctgattatgagatggaatctatgagcggactggatctcctcaaggctatcagggaacgcggggatgataccccatttattatcttcaccggaaaggggagggaggaggttgttattgaggcatttgaacgcggtgcagacggttatgttcagaaaggcggtgaaattcgatcccagtttgcagaactggcccaaaaggtgagaaccgcagtatgcagtacacgatcggcacgagcagttcatgaacaggataccagacaccggatactctttgaaacgatggggcagggagtgatataccaggacagggacggtacaatcatcgaagcaaaccctgcagcagaaagaatccttgggatccctctggatcaacttaccggaaagcgatgggatgagttatccctacacatgattcaggaagacaactctccgtttccggtagagaagcagccatcaacacaggccctgcacacgggaaaggtgattgccgataccattatgggtatctgccattcggatgatgatgaatgccgatggattcacgtggatgccacacccctgtttcggaatggagatgagaaaccctttcaagtttattcgatattatcagacattaccggacttcgggcaataaaagaacaggttaccctccatgcagagcggatatcagccttccttgaactgaaccggttgaatgctccatcacgtgcagagcttctggattatgcaataaatgcatgtctgaagattactcagagtcagttctcatttattggtcttgttaatcctgatgagaccgaagtcaccatccatgcctggtcaccttcggttatagagacttgcagggtacaggaacagaagaagaatttccaggttgcggattcaggaatctggggggatgtgctgagaacgcgaaagcctcttatcctgaattcatttcaggacctagactccggtaaaaaaagatttgtaaaaggccatgttcctatcaccaggtttttggaggttccggtttttgacggggataggatcgttgctcttctggcggtagcaaataaaacccgtccatataatgaggacgacagtcaggcactcattgcctttggaaatgaattatgggggattatacatcaaagagagaccagggaggctttatttcttaagaattatgcaattgaatcatcgatgaacgggattgctatcgcagacctctcaggaatactgacttatgtaaaccctgcttttttgtcaatctggaattatcatcatcgagatgaggtgatcggaaagagtgcgattacattctggaagaaccatgaccaggctgcagaagttatcgaggcaatcaaaactgcaaaacaatggcagggagagatggaagctgaacggacagatggttctcatgcgatcctcttagtttcagcccattccatactggatgaatcaggcacccctcaggccattatggcatctttcattgatattactgataaaaaaatggcagaacaggaactcattcaggcaaataatatcattgagggtatgcttaatggcatccatgatatcgtgggcctgcagcttcctaaccattcggttgtcaggtataataaagcagggtatgaggctcttggtctatccgcttctgaagttgtgggaaagaaatgctatgaactcatcggcagggataccccctgtgttccttgtgcgaccagtgaagctattgcacgaggacagttatatacaattcagagatatagccctgaaattggaaagttccttgaatgcaccagtaatcctatcctcaacgatcagggaaagccagagcttattgttgaactccttcatgatatcaccagtcagaaaaaggctgaagaggcactcagggagagtgaggaacggtttcgccagctcttcaacaatgcatcagatgccattttcctccatgaactgcatgatgataactcccatgggcgattcattgaggtcaatgatgcagcttgcagggctcttgggtattcacatgaggaactccttgagaaagcggtgtttgatattaataccctatctgacaaagaggctgctccggatatcaccaggcagcttatcagtgaaggacatgccttatttgaaggcacccatgtcaggaaagacggctctatctttccggtcgaggtttcagcacatctcttcgagcttcatggatcacgggtggtcctttccatctgccgggatatcactgaacggaaacggagcgaaaagtcaataatcgaagcgaaccggaaacttcagcttctatccagtatcaccagacacgatatcttaaattcacttgggggtcttctcctcttccttgatagtattccacgatcagatctctcgcctgttgtcagagaaaacctccaccggattgaggcatacgcactgactattcaaaaacagatcaaatttacccatgattatcaggttctgggactgcaaaaggcaatctggcaggatctttcccgctgttttcagaaagcatccgatcaatttgatacagggaggataacggttgaagaacatctgtcagggatagagatctttgctgatcccatgctggagaaggtcatatacaacctgattgataacgcccttcggtatggtggcgccaagctctcgaagatattcggatattaccgaacggacggtgaagatctgatatggattattgaggatgacggagcgggtgttgccccggagatgaaagatcagatcatggagagaggcgtcgggtgtaataccggattcggactctttctttcagcagagatcctctccatcaccggcatgaccatcaccgaaaccggcacagatggggagggggccagatttgagatccgagttccaaaagggatgttccgtcttggaacagatcagagaccggaggagagaggatgactgatcctgggtcagaccaatcgattcctggatttgaggagataccctatgaggcttttttttcaaacgcaccaataggtatctttgttgccgacgaccagggcagatatctctttgtgaatgatgctgcctgcaccatgaccgggtataccagagatgagctcatcggaaaaaacctcatacagttcgtctaccctgatgaccgggaatttgcatatagacacttcgcacaggtcaaggagaccggatctgcggtaggagactgccggtatgttacgaagtctaaagagatcagatactgggaagtaaaggcagtcagaatttctgatacctgttatatcggatatacctcggatattaccgataaaaaacgatcagagcatgaaattgtacggaagaatgaggaacttcaggcaacttttgaagaactttcatcaaccgaagaggagctgaagcagcaacttgaagagatcctctcggcacaggcagagattgaagaacgtgagcaaaaatatcgccttttattcaacaccagcgaagcaggtattgctctgcatgaaattatctggaacgaagaagatgttccggttgattaccggttccttgaaataaacccggcatttgagaagattaccggactttcagccaaagatatcatcggaaagcgggtaactgaagtcctgcccggtgtggagtcatattggattgaaacatacggaaaagtagcacgtaccggaaagacagtgcatttcgagaatttcagtcatgaactcggaaaatattacgaggtcactgcatactccccggtcaagggccagtttgcaactctgattcaggatgtaaccgagcggaagaaacaggagatacagctcaaagagacgaacagctttcttgaaaatcttattaatcatgcaaatgtgcccattattgtctgggatccctcattcaccattacgcgaataaatcacgcattcgaacttcttattgggaaacctgcaaatgagatcgtgggaaaaaagctcgagaccctcttccctcctgatgaggcagaacgctcgatgcggctcatccagacaacccttgaaggggtcaggtgggagaccgcagaaattcctcttttaaataaagatggtgagataaagacagtcctgtggaactcggcaaccatttatgatcctgatgggatgacaccccgtgcaactatcgctcagggcagggatattaccgcagaacggcagctagagcgggaaaaagatgaggctgctgcccagatacaggaaaatattgcaaaactggccatactcaatgacggtatcagaaatcccctcaccatcatcgcaacattcactgaaatggctgcggatacacagactgcagacctcattcttgcagagataagcaggatagatgagatggtaaatagtcttgaccgggagtggataaaatcagaaaagattctgaacttcctgaagaagcatgatttcgaaaagaccggatttgacatcaacaaatacccggatgtattaccagatatccatcagaacggtgaaaaatcgggttttagcccatccggcagatatgaactctttatcgaagagctccaggcacaactctataccatcttggacagtattgatgccctgatttatgtagcagatatggagacgtatgaaatcctctacctgaataaacagggtcgttatatatttggaaatatcctgggccagaaatgttacacctatttccagaataatgcagatggtccctgccagttctgcacaaaccatctcctcgttgatgaaaaagggccaacaggtgtgtaccggtgggaatattataataccagaaccggaaggtggtttgactgccgggaccgggctatcaggtggacggacggaagacttgtgcgactggaaattgctacagacataacagagaagaagcacaaagaagaagagatcaaagaaagtgaggaacgattcaggactcttgtcaatgcaatacaggagacaatgtctgtcattgaccgggacgggacattcatctatgcaaatgccaccgcagcaaggaatctttcaggtaaggatccatcgtttgtaatcggaaagaacatcagggattttgtatctgaagagaaagcagaagagttgattcagaattaccggacaaccattgataccggcattccgtttgccggtgaggttccggtaatgatgcagggggagctcaaatacttttataaccggctgattcctttcaggttttcccaggatgacgagcaggcagtgctctccctttccctggatattacgaagcagcatgcaatcagggaagagctgactcttcgggaggagcagtaccggagaatagttgatactgcacaagagggcatctggcagatggatcgacagaagaatacggtatatgtaaatccacggatggcagagatgctcgggtttactcctgaagagatgctggggaaaaatgtcacatcatttatgccaccagaggaacttgatcatcatgcacaaaggatgatccaccggatgcatggagagaatgagcggtatgaacaggagtttgtgaaaaaggatggatcccggatctggctgcatgtatcagcaaccgctctggtaaatgcagatggaacgttcaacggctcttttgcgatgcttaccgacattaccgaacaaaagagggcagaaaaggcacttattgagagtgaaaccaggttttatgaactcttcaataatctgcctgttgcagtagccatttatcggccggtagataacggaactgatttcatctttacagactttaatcgtgcaggtgaacagattgagaaaatagaaagaacagacattattgggagaagtgttctggaagtattccccggggtcagggattttggtctttttgaggtttttcagcgagtatacgagactggaatccctgaaaaatttccgatctcattttacaaggacaaccgggtgaccggatggagggaaaattatgtctacaaacttccatcaggagagatggtcgcaatttatgaagatatgacggagcgaaaacaggcagaacatgaactgttcgttctctcccgttcactatcagaagcgatgaagattgcaaaaatggcagcatgggagtatgatctgaagaccgggatgtttacttttaatgacttgttttattccatgctcaagataacggctgcagaggctggtggttaccagatgtcagctgatgagtttgcagataggttcatcgtcccggcatatgccagtcaggtacgtgagataatacaaaaggcagcagaatcatctgatcccgaattcgagatgataatcgagggagagctacgccgtccggataacagcaccttctgggtgaccacctggctgaagactgaccgggatgatgcaggagagattaccaggctcttcggggtcaaccaggatattaccgaacggaaggagatggagactaaactgaaagactccacacagaagttactgctcctcacccagatcaaccgacatgacatctttaatgagctgacggcaatgcatctcatgcatgaccttgcccttgataccaacgaccttacggagatctactcacttatcaagagatctgaggaaggactgcgaaggattgagagagtattacagtttaccaaggagtacgataattttgcctcctcacagagtttgtggatggtcctccaccggatcatagactcgattcgggaagaagttgcggcaggggatatcctttttgaaaattctgttccggagaacattgaggtttttacagatccgatgattcaaaaagttttcaaggccctgtatgaaaatgctattcgacatggacagaacctgacaaaagtctggttttacacccaggagcgtgagggaggtctgataatttactgcgaagatgacggtgtaggaattccggatgtagagaaagatgcaattttcagatatggccatggaaaacatacgggaataggtctctttcttgcgagggagatgctttcgataaacagcctgaccatatgcgaatctggaatggaaacaaaggggtccagatttgaaatacatatccctaaggggaaatggagatatagaagaagtacctccgataccactacaaattcagacagaagagagcatacaggagaatagaacgtatcgatgaatctgatccgaaatttttcgttgaaacacgaatcgcatagggaggattatacaattcgacgtatcgcatcagacttttcgatcgtatggtatcagaatagaatattcatccaacctgccgtgctctctgaataattataggctttctccggggatcagctttccatgcatccagacaggggatgattttacgttccattttctgtacgaatggtacactttttggatcataaaagtgttgcaaaagtacacttttctgaacgttcgctcaaaaaaagtccttcaatatctctgggggtttacttcgattccccgtcagtaatggacgctgtattaaaattatgatgttttcgaagaaactcgaggaccttatcagactccatccaccggtgatccagatcattcacgatggaatctatctttgcaacctgctcactgatcttctctgcaaattccacgtcatcagacatacttgccagcgtaaggatgatactgagaggattgcggatctggtcattgagaaccgctagttttgcaatattcttctctatctgtctgactgctgcagttttttcatcttcgagctgccgttcccgggtgatgtctttccctgaagcaagaattccgatgcatttgccagaaggagagcgaatcgcatgcataaaccatgagatgaaccggggtgaaccgtcactggttagaatttcccctttgaaccgtgaacaatctccataccagccctggaagaattcatggaagaattgccgtgtcagggcccattcagaggggggaagaaactgatcaaaccagttttttccaatgatatcatcatgcgaaagacccaggaactcacaccctctccggttgataagagtgattgtgccatgccggtcaaaggccagaatcatcacctctgcaacgttgagatactgatgtgcacgttcccgttcaaacctgatccgttcagcggctttcacctgctctgtgatatcatatgcaatcccgataacgccgttgattatctgatccggtccggtcataggggtgagcgaggtctggaagattaccccgttatgatcatattcaaatgttacttcttctccgcgtaatgcacggatatgcgcctctattgccgggtgattcccttttgaagagtgaaaaaaatcataaagattctgtccgacaacttctccgggggtaagaccaataagggataggccctttccttctgatagaagataattgagctccctgtcaacaacccagagagttgccggaatctgccgggtaataaaccgcagttgttcctcacgcttacggatttcatactccgcctgggcaagctgctggtactggagacgcagctcatcctgctgagcgatgagttcctcatttaaaacagagatttcagcattttgaaggataagagagttatagagtttctggtaatcttcagtgtattcgggttttttctggagaggatgctgatcaggagcatctgggagaggggtagggatctggcgccttgagttatccattatataactccggattcagatgagactaatcgattccatcgctgatatgggagaccaaagaacattttttggaaggaattaatactgatggtaagatcagtagattgcataaacctgattaaaggtagtccataagtcgataaatacgttatattgtgctgtacatattcaagccatatagcatcataaaaccggaagaccgtcatttcaataacaggagtcagaaataattatgaaattaagatatattattattactgattcatatctgatatcaacttacggacatcaatccagataaccagttcttttctgctctctccccgctcacctacttccttctttattatcccaagaatatgcccctcttcttcagtgccaccccgtgcagcctgatcaatgtccgtgaccggcacggtcagaactgaagtaacctcatccacaacaattccggttttttgtgacgagaccgtatcatccataacaataaaccggaggtctgcagaagacttgtcttttgctgctgcaatctgaaggagctgacgaaggtcaatgatcgtggttatctcaccgcgaagatcaatgattcctctgatatgggatggagcgtgagggagaggggtaatttttgaggcttcaacgatctcccggacatcaaagagattcactgcaaatttatcctctccaataataaactcaacaacctggatttcatcatcctgttcctttttgccagtatgaatctttagatcagcaatttccatgattccctctaaattttaaacttcgccatttcactggagacaatttccacgatctcattcacatttgcaactatcttactgatctggtcaatagacgccgaagcttcctgggttgcagctgctgcatctcctgcctcttttgccgtattttgaaccagcccgcttacttcattaatactggcggttacttcttctactgatgctgcctgttcttctgatgatgatgccacatcggttgcgttccgggtgatgtcatcaatggatgctgcaatctgctcaaaagccccgagcgtttctgaaagggcagaacttcccatggcaacagtctctcctgcatgacccatggcatcattcgcctttttggcttttgtctggagggccatgatcatatctgcaatattctcggcggactgacgtgaatcctgggcaagggatttgacttcagctgcaactaccgcaaatcctcgtcctgcttcaccggcccgtgctgcttcaatagctgcgttcagggcaagaaggttggtctggtttgcgatatctgaaatgagtcttacaattttaccgatctcatccatctgctgattgatgtctttgactatctgatcaacttcagacgatgaccgcttgatctcctccattgccgtctcagatttttgtgccagttcaaccccgttctttgcatacccgtttgctgcggttgcggtggatgatacctcctcggcacggcgggatacttcagcaacggtggtattgagatcttccatagctttgagaacctggtgaataccatcttctccccgtattgcattagaactgacttccccggcattttttgcaatttgttgtgctccggctgaaacctcctcaatacttgcggtcgcttcttcagcattggaggcaaggtcaagaagttgtttattgataagacccacagctgccgatatctggataccgatattgttcagggcgtctttaaattctacccagtcacctgataccttcagtgatggatccacccgtgcagtaaagttggaatttgcatattctttggaaacgcgaagggcttcgttcaccgggacgataacactgtccagtgtctcattgactccttgtacgatcttgcggaaatcaccctgatgtttggaggcatctgcacgtgttttaagttttccatcaagtgctgccctggaaagcatatttgcatcatcgaccagagcgttgacagcatcaatacagacatttagattattcttgatggtgttgaaatcaccgttatagttatcagtgatctttgccggaatatctcctttggaaatacgatcaacatatctcgcagcaacattgagcggtccaataaccgcgtctagcgtatcattcacaccctcaacgatcttccggaaatcgccctgatgtttggaggcatctgcacgggtatctaaacgaccttctacagctgctttggaaagtaaatttgcatcctccactaatgctttaatattatcccgtagttgtatcaaatattcatgaatttgatctttttctgaggctttttgaacatctgcagtcatatcgccctcagatagttttgtcacgtacacaattaagtctgaaagccaaagaggctgttgcacaaacacaaaaaaagcttaatataaattattaaagcttaattatatatattattaagatcaatatattatatgtctcatcgctataacatgattagaggatatggtaatgaacaacaatttttactccctgtcaatgcgatggactggctatctgaaaatgatattacttatggcatattagaaattctttcgattctcgatattagtccatttattaataaatatcgtgacgatggtcgcggttctgccttttttgatcctcgttcaatgcttggaataataatttattcaatgattcgtggagaaaaatctagcagaaaaattgagatgtgctgccattatgatattggatatcggatcgtcgccaataatcttacacctgaccatacaacgatctatcgtttcaagaagaataattcaaaagaaatcaaatccctttttaaacaattatctcaaattatcgtagaatccgggatagcaagaatcggtgtcctagccctcgatggatcaaaatttggctgtaatgcctctttatcagccaataaaaaattaaaataccttgaagcagagctaggtcggctttttgatgaatcacaggaaattgatgagttagaaaacgatgatataaatattcaggatatggagattaaccgactacctgagcatctttcaacaaaagaaaaacgaaaggaagttcttaatcgggctaaagagaaattaattgaacgacatgatatcgaatctaaaaaacaagaagaaaagattctggaccgcgaaaaagaagaattagaatcgggtaaaaagaaacgaggtagaaagcctttagagcctaaaaaagagccatcttcagattcaaaagtaaatctcactgatcctgaaagtcagataatgtcaaccaccaatggctggattcaagggtataatgggcagattatcgtttctgaaaatcaatttatcctcgctgcaatgatatcagatgagcaaaacgataaaaaattattaatacctatgctaaatgaactcgaagacctttttacgggtattcatccatcaatttcgcctaatatactactatctgatgcaggttatttctcatacccgaattctttagcagaattggattatggcattcaactcatcatccctccttctaaagaaagaaaaattccagaatattcagataatgatgggtatatctcacgaatggaaatgatatgtcgggcgatttgtatgggagaaataatcacatttccggaattgcaaagtatcgggacgtttgtttggcaatcttttatgaacagagagaaacaagcaacaactcaggaaatttgtaaacgagttatggaagtacgtgtgaaatcccccactggtagagagttatatcgaaaacgaaaatacatggtcgaaccagtttttggtaatatgaaacataatatgaggtttaggagtttctctcaaaaagggaaagagaattgcgagggagaattctttttagctgcattagtgcataatataaaaaaacttatcagatttgagggtatagttaaaattaaagaatttgctacgaatattataaaaccgtcaagaggttcaggtttttcctatatttttgcaaacacagtatgtaaagtgggaattgatacatgcaggttcatacatcaattagtctattttggttgatagcttaaggggtagagatcgatcatttgtgatcctgcatgatattgatcattggtgcaacaccctccaaagatgaacaccatttatcgcgtttttcatcttttcatgatcaccatgacaaacgatctctactttttcacggagatttccacccctaatctgctcgagaatacggttaccctctccaatagggataagaatctcatcgagcatctgattcataccccggatgacatcagcatatgctcctttgaactgatccgggtttccacgctcagataattttcccgcttttgaagcttcggttaaccgaatcaattcattttgtaatgcctgaagggtttcatacaccttaataaatgcgggaacaagtatatcttcatcagacctcttcccaccttttacaaaattattatactctgaaagatctccgttgcttatttgaattatggagtttgcgatatgattaacccggtccctcacttcattcacatcagatgcaacaagtgcaaaatcaccaagatatttcttttctatgccatgtgagtagtcattcacagccatccttttaaggacagcagaaatgtcatgtaatggaccgatgacggcatccagggtatcattcacaccctctacgatcttccggaaatcaccctgatgtttgcttgtatctgcacgggtatttaaacgaccttctacagctgccttactcagcatatttgcatcggcaaccagagcgttgacagcgtcgatacaagagttcagattattcttgatggtgttgaaatcaccattatagttatcagtaatctttgccggaatgtcacctctggatatatcatcaacatatctggcagccacattcaggggaccaataaccgcatccagggtatcattcacaccctctacgatcttccggaaatcaccctgatgtttgcttgcatctgcacgggtatttaaacgaccttctacagctgccttactcagcatatttgcatcggcaaccagagcgttgactgcgtcgatacattgattcagattattcttgatggtgttgaaatcaccattatagttatcagtaatctttgcaggaatgtcacctctggatatatcatcaacatatctggcagccacattcaggggaccaataaccgcatccagggtatcattcacaccctctacgatcttccggaaatcaccctgatgtttgcttgtatctgcacgggtatttaaacgaccttctacagctgccttacttagcatatttgcatcggcaaccagagcgttgactgcgtcgatacattgattcagattattcttgatagtattgaaatcaccataatacgtatcagtgattttttctggaatatcacctttcgagatacgatcgacataaccggcggcaacattgagcggcacgataaccgcatccagagtatcattcacaccctctacgatcttccggaaatcaccctgatgtttgcttgcatctgcacgggtatttaaacgaccttctacggcggccctggtgagcgtcagaacatcctggattgctgctttttgagaggtaagatcaataataaactctactgcaccggtacataccccctcatcatttactatcggggttgcggtgatgagtatgggaatatcccttgaaccgatgtgggcaaccgtctcttcagtgataacccgacgttcccggatacttcgcatggtcgcacaattcccaccctgacaaacatcattttgaaacagggtatggcaaattgtcccgattaaatcttccggttttttctgaaagaggtctgctcctgcattattgatataagtaattttctggctcatatcaatggcaatcaccggggttgcaacaccattgagtaccccctgaatctcctttccggcgcgtcttaaatcatcttcctttttcttgatctcagtgagattctcaaaatattcaactgctccaatgacctcacctgaatcattgaacaatggagaggcatagtaatggatggggatatcttttccccgtatgtgagcaacagtctcactctcaatctttctcttttccctcatagcccgaagggtagcacattccccaccatcacaatcgtcggttctgaataattcatggcatttctgaccaacagcctgctcacgggtcaaagccagtatttcaagagcggcatcattgatcatctgaattgtcctgtcaggacttatttgaataaccggcgttgcaaccccgttcagaacattctgacagaatcctaaatcatctctatcaaaagtcatccgatatcaccaatactcagtaaatatgtataaactgtgattgagtataacacggcttatttgccgggcaataatgccatgcatatcgctctccttattatctctgaattaaaaccagaaacatatgccaagccaggagagtgacattgcaaccagttcacgtatcctggaattattatccgacgctccacagggagccagtatcggggagatatcatctgccctcaacatgaaccggaacctggttgcaaaatatctgtccattcttcacatgcagggcagggttgaactgcgatcctatggaaaagtgaagctttacaaaaaaacgacgagaataccattccatgccctttcactgattacccgtggctgtgtcatcggtcttgaccagctgttgtatgtcaaggaggttttaggctattgcagggaaatgaccggatcagataagaatgaattattatcaaaaccattttcagaaatatttcatccggcatttaccaatcctgttgtaaaaaaatacatacaggaatatcggaatggagcagtcgcaccccctctttataaagagatatcctggcgtaaacgaggatttgatctcaccgttgttccctgtatatttgatgatgggacacaggggcttgcacttatccttgccgaacaggcaaacaatgcaccctcccataaaaaagagaagagccacatcagaacctaccagtacctgactcgcgagacgccgaactttatccttcatctgaacgccgagggagatgttctgtatgtcaatgaatcgtatgccacttattgcaatgcacgggcgtcagatcttctgcacacgaatggcatccctctagccacccaggatgattttacccgaatcaaagaggatgttttaaaaaactggtctttgaatgaaccgacagtcagcgatattcaggtcgtgatgaatgacggatctgtgcgatggcagacctgggtatttcatccggtcagagaacagggcatcctgactgaacttcacggatatggcagagatatcaccgatgagcgtgaaagagagaatctctacctgcgactccaaaaagagtttaatcaggatgtccaggagaaaacatctgaacttcgtgagataacggcccaactcaggaaagagattgacgagcgaaagtcacttgaactggcactgaaaagaagtgaagaaaaataccggaacctgactgagattaccaccgacataatctgggaaacagatctctttggaacaatcgtatacatcaatccaaaagcaacatccatcctggggtattctcccgaagaattagtcgggaaaaaaatctggagtaaaattaatccggattaccggaatcatatcgagcactatttttcaggggctaaatgttcgccatttgaacagattgcattccctatgacccgatctgacggattagaagtatggattgaattttccggcataccactgtttaatgatgaacatcagttctccgggtatcgggggatcggcagggatattaccaaatcaaaattgattgaagagcataatcaaaggcttcgtgccataatagaaaatactccagatattgtcagaatttcagatattcatggagatctcctctatatgaataaggcaggaagaaagatcctgaaaatacctgaaaccgaggatatcaccagatataataatgccagtttcatgacttctgatgaatggacaaagattcttgaaggtcggagtattgccatcagggaggggatatggcagggactgaccagacttatcgcaacggatggaaccatcatcccggtatcgcaagtaatcatcgctcataagcaaggcaaaggagaagagatgctcttctccacagtagcccgggacatatcagacataaccaaattcagacaggaacttgaagatgccagcgtctatagcaggaatctcattgaagtaaaccttgatccactcgtgaccatcggtcctgatggtaagattcaggatgtcaatcacgcaaccgagatggcaacaggattttctcgcgagaaacttatcggaacagacttctgctcgtacttttcggacccggtgatggcaagggagggatatgaacgtgttttcttacaagggtatgtcagggattatccgcttgaaattatccataaagatggtcatagcactccggtcctatacaatgcttcagtataccgggataaaaacggaaatatacagggagtattcgcagcagcacgtgatatcacagagatcgtaaaattccagaaaaaactggaagagtctcataattacacacgaaatttgatagaggcatcccttgaccctctggtgaccatcggtcaggatggaaagattcaggatgtcaatcatgcaaccgagatggtcaccggatatgccagggagaaccttatcggaacggatttctgcgcatactttaaagaccccaaaaaagcaagggagggatatgaacgtgttttctcacaagggtatgtcagggattatccgcttgaaattattcataaagatggtcatagcactccggtcctatacaacgcttcagtataccgggataaaaacggaaatatacagggagtattcgcagcagcacgtgatatcactgccctgctggaaagtgaattcacacttgcagcctcacgggattattacctgaagatcctggatgaatttcctaatccaatatggcgctccgggcctgatgcaaaatgtaattacttcaacaaagcatggttgaaatttaccgggaggactctggaagaggaatatgatgacggatgggcaaccggagttcacccggatgatcttgatcggtgcatatcacaatacctctcttcatttgataaaagaatcccattttatatacaataccggctccgccaccatgatggctcatatcaccggattgccgactatggcgcccccatctatgatctgaagggagaatttaccggatacatcggatcatgttatgacctggacaaggaggaaccatgatccgggtccaccctttaccattaacctgagcggtgaagtaatagcctggaaccgggctcaggctgcccttaccggaatttcgggagatgagataatcgggaagggagacgggatgtatgcacgagcactgtacggggacaaccgtccgatgctggtggatactatcctcaatgaaaggattccggtttttgagtattaccgtgaaatatgccgggatgcgggtaccattaccgcagagacatcatggggaaggtcaccatctaaaagacaattcaatcaggcatggagaccgggccacccatatttttattcacgttgaatcatcataggataatctgaatatcatataccaggataatgggtgtggaattttagatgatgtgaaagagcaaattttccagattgggttcggttcagataccggtttaggactgtttcttatcagggagattttacagattactggtttgaccatcaccgagaagggagtgccagggatgggagctcaattcattatctcggttcccaagggtaggtttcggataggttcgtgataaggcgcgtcaaaaatatttttttcgcagagtatttcaccggtaattctaacagccagaacatataagtgtacgatcatcaaaacggaatgaaatactcatcaataacatgactcagagaaaacttcccatcggtattcagtcgttccaggagattcgaaccggaggatatgcatatgtggataaaacgccatatattgcgtctcttgtgcgggaaggaaaatactattttctatctcgtccacggagattcgggaaaagtcttttcattgacacccttgagtgtgctttttccggaaggagtgatctcttcacaggtctgtatcttcacgcagtggaatccgggtgggatttttcacacatatatccggttctcagaattgattttgctggaggaacactccggagtcaatctgacctgacaaaccgcctgcacaggatcctggatagctgggaacataagtactccatagggccttcaaatggttctcccggtgaccggctcctcaccctcatcccccaaatttctgaaaaaacacaatcacaggttgttatacttgttgatgaatatgataaaccaatcctggataatctgggtgattcatacctcgccactgatatgagggatctgttaaaagatttttatggagcgataaaaccacttgatgtccatgtgaaatttgttctgctcacaggtgtctcaaagttctcaaaaaccggaatattctcaggactgaataacctgaaagatatcacacttgaccgcaggtattcagcaatctgtgggtatacagaagaggatctggagaacgtatttgcagaatggctttgccagtttcataagcacgaggtcaaagagtggtataacggatacagctggacaggccagccagtctataatccctttgacattcttctgctttttgaccagggaatatataaggcccactggtttgaaactggcaccccgtcatttctcataaatctgtggaaacaatccccacgtcttcctgcagaatatgaaaatctcatcgccggtgaggagttactgggatcctttgataccgattcaatccggttagagacgctcctctttcagacaggatatcttacgatccgctcatgggtaagcaatgccagtgaaggaacctggtatactctggggtttccaaacagagaggtcagggaggcatttaacaaacaaatactactcctttttgattcgaaaaaacaggttccacttcccctaatcaggacggcttttgagtctggagatacagaaaaattacgttcactcatacatgcattctttgcatccataccccatgactggtacagaaaaacccagataaaaaaatttgaaggattttatgccactgtcctgtatgcctactttgccagtctggggtatgagattactcctgaagacacaacaaataagggaaggattgatctcaccgttaaaaccagaaccgggatatggatttttgaatttaaagtactaggccttgatacctccagggatacaagccctctgacccagatcagagaaaggagatatgcagaaaaatactattccgatcaaaaaaagatctacgagattggaattacatttaacccggaaacaaaaaatatcgataaatgggaagttggataacctataattcaccccgctccagaagtatcggactcacatcatataccttgtatcctgtattgccaaaacaggagatgatatgaagtgacagatctgctttccggatatcaggtttggtaaatccgggcataccctcaagctgaggatgaaatgctataacgtgttcgatattatagcagaggtaagattgtcaatcgtgatcgggagaataccggtaataaatatgttcgcgattgcacctgattgcctcccggcatttcgacttgaaagatggattttaaaaataattaaaagaaaaagacggttaagatttatatcttaaatcgtttcatctcatcattggttaccgaaacaacctcattaatctcattaattatggttgttatctgctcaaccacagtcagggcctcctctgcagtggccgacgaattcagagcatcctttgcagtgttcttgacaagtccgctcatctcgttaatacttgcggtaatctcttcaaaagaagcagcctgttcttctgttgctccggccacactggtcatattatgactgatctccgccacggatttagtaagatcagtaaatgccgatatggtctcctgaaccgctctctcaccctggttgatagcagaacctgcctgttccattgcggtgacggccttcatactctgtgactcaagattactgatcatggttgcgatcttctgtgcagattcaccggtctggttcgcaagtgcctttacttcaccggctacaacggcaaaccctagtccagcatcgccagcccgggcagcttcgattgctgcattcagggcaagaaggttggtctgttcagagatgtcggtgataatcccgatgatcttggtaatctcattcatctgagactggatatcccggatcacaacttcgacctcgtcagatgaacgtttgatactcatcatcccattttcagcactcgctgcagaatcaaccccttttcgtgccagctcatcggcttcagctccggcacgggcaactgcttcgacattggaagacaccgatgcaacggtactggtaagatcctccatggcccggagcacctgggagattccttcttcactctgttctgcgttggttttagtctggtctgcattatcagcgataatccctgcaccacgcctgacatcgtcaataccaactgttgcttttgtcgcatgaacagcgagatcatgcatctgcctggtcacaatctcaagtgcttttgagacctcgctcccaatggcatcaagggcctgcctgaatgcaaggaaatcacccattaccgggatgtcatgagggaaccgggcagtaaaatcacaatcggcataactctttgagagctgaattgcaccgttcagtggatgaatgagtgcttcaagcgttgcattaaaacctataatgatctcacgatatgaacctgccaaatcaccgggatttccacgaacggtaagatctcctgctgatgcccgttcggacaagatctttaactcagttattacagattttagtgacgcaagggtatctttaagagcgggagtgatctgatcattcccacctcttatcgtgagatctgcagagagatctcctgcggcaatctgatgcatggtcccgaccacgtcgtgttcaagataatcagaaaaacggtcaaacattccggccatttctccgacttcatcttttcgttccagatgcagacgaccggaaacaactccctggctcatctggtcaaactggtccatgacctgccgtagaggcagagtaatacttcttgtcaccgcgaatgcaaatcccagggcaataattaccgcaaggaagcccagaataatcataaccggaacggtccgatccttttcagcctgaccctcttgtgcaatctgttcagcatgggtgagaataccggattttaatttgtcgaacgtatcgacggtagcccggcgtgcattcgagtgttctcccccatttgctatggaaaccagtgcctcattggtctttccctctgataataatgagaatactccctgcgcagccgatttatacgcattccattgttcttcgaattttttaagattctgctgtacatcgggcgataatgaaactgttttcagacgtgcaatcttttcatcgattttttgtatctcactcgtaatccgatcataatcctgggtccgttctgcaggaatagcgacaatccgaaagaccagtgcacgaattgaattgagtgaggtttcgatctctgatacctcaagaagcggtattgttccatcagaatagaccttatccatcccgatgctgatagaattcatcccgataaacccaatcactccaacaaggcccatcaggaggatgactatgataaaaccgataagaagacgcggtcctatccgaatatttgaaattatatccattatgctcatgatatccactgatgataacgttcgctcatagtaaaaatttgagaattaattcagcttttattcttataggtgaacttatccatttcggtgccaatcgttttgaccacttcattaatctggctaataacatttgttatctgatccacaaccgcaagagcctcttcactggttgcagatgagttcagggcgtcctttgccgtatccttcacaagcagactcatctcgttcacacttgcagtaatctcctcaaatgatgctgcctgttcttctgttgcactagcaaccatctccatattccgggtaatatcctcaaccgacgtcgtcagggtattgaatatgccaagagtctctgaaagtgctgcacttccttctgcaaccgccgttcctgcttcagccatcgctccggatgctgcatcactcttcttttgcagatcactgatcatgtcagcaatatgttcggcagactgcctggaccgttgcgcaagagacttgacctccgctgcaaccacggcaaatccttttccggcctcaccggctctggctgcttcgatggctgcatttaatgagagaagattggtctggtttgcaatgtcagtgatgagatccacgatctttacgatctcgtgcatctgtgccctgatctctgcaaagatcgtctcaacctcttcactggtcttggtaatgctctgcattcccttatctgctttccccgccgcaccaattccctgctttgcgagatcattcgcctggacactcagacctgcaacccgttcagcatttgacgatacctcggagatcgttctggtaaggtcttccatggtctgcaggacctgattgattccatcttcactccgttcggcattctgctttgtctgatctgcattcttggcgataagctcagctcccctgcttaaatcctctatacctgtcccggccgtctccgcctggtgggcgagttgtttcatctcacgggcgataactgagaggacttcggagacattcattccgatcgtatcaagggcatctctcaggagggcaagatccccttcaatcttcagattccgatcaaactccgctgcaaagttgcctgaagcatataaattcgagattctctgtatctcctgaatcgcgctttgaacaaaaatgccgatattatttaatgagtttttaaagaggacaaaatctcctgcaacatggaggttctcatcaacacgggttgaaaaatcagccttcgcatatcgttcagcaacccgcatcgcctctttcaccggaccgataaccgcatcaagcgtggcattcacaccttcgacgatcttcctaaagtcaccctgatgcttcgtggcatcagcacgggtatccagtttcccttcaaccgcagcacgggagagcataccggcgtcagcgatgagacagttgacggcatcaatgcactggttcaggttattcttgatctcgttgaagtcaccgttatacgaatcagtgatcttcggggggatgtcacctttcgagatacgatcaacataatcggcagcgacattcaaggggccgataactgcatcaagagtggcattcacaccttcgacgatcttcctaaagtcaccctgatgcttcgtggcatcagcacgggtatccagtttcccttcaaccgctgcacgggaaagcataccggcgtcagcgatgagatagttgacggcatcaatgcactggttcaggttattcttgatctcgttgaaatctccgttatacgaatcagtgatcttcggggggatgtcacctttcgagatacgatcaacatactcggcagcgacattcaaggggccgataactgcatcaagagtggcattcacaccttcgacgatcttcctaaagtcaccctgatgcttcgtggcatcagcacgggtatccagtttcccttcaaccgctgcacgggaaagcataccggcgtcagcgatgagatagttgacggcatcaatacactggttcaggttattcttgatctcgttaaagtctccgttatatgaatcagtgatcttcggggggatgtcacctttcgagatacgatcaacatactcggcagcgacattcaaggggccgataactgcatcaagagtggcattcacaccttcgacgatcttcctaaagtcaccctgatgcttcgtggcatcagcacgggtatccagtttcccttcaaccgctgcacgggaaagcataccggcgtcagcgatgagatagttgacggcatcaatacactggttcaggttattcttgatctcgttaaagtctccgttatatgaatcagtgatcttcggggggatgtcacctttcgagatacgatcaacatactcggcagcgacattcaaggggccgataactgcatcaagcgtggcattcacaccttcgacgatcttcctaaagtcaccctgatgcttcgtggcatcagcacgggtatccagtttcccttcaaccgcagcacgggagagcataccggcgtcagcgatgagacagttgacggcatcaatgcactggttcaggttattcttgatctcgttgaaatctccgttatacgaatcagtgatcttcggggggatgtcacctttcgagatacgatcaacatactcggcagcgacattcaaggggccgataaccgcatctagagtggcattaatccctttggcaagcaggagaagatcgccctcatatttatccggatcaacccgggtatcaagctggcctgcttttgcagcttgagtcagactgataatatccctgactgcagtcttctccgctgttttatccacataaaaactaataactgatagaacatcgccattgtcgtcaaggatcgggagatagaggtattcaagtaccttctgccctgccggaacatcaagttcaagctctcctgaaagaacggtcttcatttcaatggcatcccgtgctgttcttccggttcgtttggtcaccgtaagttcggagaggttcatcttcaggagttgttcggttgaataaccagtaacctgagaacatgctgagttgatcttcgcaatagagaggtcaggattaatttcaaatatcggcaccggggcattctgaatgataaactctgccttcctctgcaaaagtctgctctcatgtgcctgccggtatcttttttgtgagtgccgggagctaccaacccgaagcgcttcatcagatctcatcgatcgaatcaccatcctatgtagtcattattggaaagcctggggtgtttcaggcccctgatggcagaaacctggtatcaatcagggcagaatctattaccgccgttgataaaactgtggttgactgctggattctggatactgcccggcttacgctggaccggattgagaagaataatgacgatcccgatcatcagaaagctgctgaaatatatcagcggccatttgaatcctggagaccaaaagtaaaagaagcacttgcttctatacaactctgattttttgctgaaaaaagttatattacggttattaaccgctgtttataaaccgtacttgcctgtccgcctctgtttaccgtcagccggactgagaatgtccctttcttgagataggtgtgatatggatttttctgatatgaaaatccaccatcaccgaatgaccatgtccacctgttcgggtttccatatgactggtcaatgaactgtacccgtaatggtgcccttccataggttggtgcagcataaaaagcagcacttaaatcagaccctggtttcggtgtaggtgatacggtcggtgtcggggttggatatggagtatatgtcggcgttggtgtcggtgtcttcgtaggcgttaccgtcgggtaaggggtattggttggtgtcggagtcggcgttggggttgatcctccaagggcctttgcggcgttcagtcttcctccagatccaaccttgccggagagggatgatatcgtatcaacactgctgaagattctgcttcgaatctgggtcgcagacattgacggattttgtgactttatcaatgccgcaactcccgacacatgtggtgtggccatggatgtcccgctcaggtactgataggtgcctgatttggacgtgctgtaaatactgacacccggcgctgcaagatcgactgagttgggtccataattggagaatgatgccagtttgtcattataatccgtcgccgctaccgagaggatgttactgctggtaaatgctgccgggtactggggagcaatatccgaatttgcaccgctgttacctgctgcacatacgacaactgcagaagatgcatctatggcatccttcagtgactgggtatacccggtaccactccatgagttggagattacggctacccctttccggttggcgtataaaattgcagaaattgcatcagatacatatccagagccctgggcattcaagaacttgagtggcattatctttacattccaggctgtcccggtgaccccgatcccattgtttcccaccgcagcaatggtacctgcacaatgagttccatgaccattgtcatccatgggatcattgttctttgagacaaagttccagccccggacatcatcgatatatccgttcccgtcatcatcaaccccattgatgatctcaccggaattttgccagatattcgcagcaaggtcaggatgattgtagtcaacaccagtatctacgacagcaacaacaacattgggtgaaccggtcgtgatgccccaggcttcaggtgcgtcgatatcggcatcggccattccataaaacggggcctgtccggtgttgtgaagtccccataaatactggtagccgggatcattcgggtatgcagcagaattgatactcatcgtatcgacatccgccacttttccggtcttttcaatcggacttaaggagatcttgtagtctggttcgacatacaaaacatccggactgtttttatatgcctccattgctgcatcaagtgtgttcgtggtaacctgaacgacctgcataccaggaattcctgcatcactcaggtcctttaccaccgatgttccggcctgtgtatttgttgctgattgaatcgacatcatcgaggattcagctcgtgggcggtcaggattatatcgcacaatcagccgatcaggcgcatattctgttgacacttcaaccgactggacagctatgggaagagctgaagactgtaatacagcaccagaaacccccggtgataccgtcggaggagaaatctgttgtattggcgatggattggataaaatactctgatcaggaatcgccgttcctgcctgtgtgagtacacagatgatgactatcactcctgtaagaagagtgagagatgaaatgttccctggaattatcatgtaaaccccctgtgaaatagcacagctaatttcttatttgccgtctatatgaaagaagtttcccgaacaatgactcttgatcaggcaaacagagaaaagacctgatgttgtatatataatgcatctgcgtatcaccgggttcaaatagatccagatgcagaattgtaagtaagacccccccgggtgatgtgatgctgatatcatgggagatataatctgcccgaaatgcaactcgaaagacacggattttgaagatctggtcacgacggaatcaggaagtatgattgcaaaatgtaaatgcaatgcctgtagtcatacttgggatatgccgttcgggttgtaatagtgtaccgctttctgatttatcctatggaattgttacggaaatgaaatattttcatagaatgaatgtcggggtcatcggacttggcattttaatcttttgctggggatttgtctggcttggaaatgatatcggatggtggaatttttccttccccttctggccggtaattgtgattctcactggtattatgatcctcctgtatgaattgaaaaaaacagtcagggaggagtaatatatgcctttttcaggcttccgataaagatacactcatccggtgcgataagatctatcccttcgaactccccaaactcgatatcaagaccacgaaccaaggctgccggggtctgttcatcggattctcccatgaccagttcggctgcagatgcgatattgtctgcgaccgcccgcctggtgaccttgagttcccggccaaagagatcttttcttcccctttcatcgatgatggcaggaatgccggaacaggcgatggctacccctccggatccatatcgcatgggatgagtcctgctgtcgataatgagaattgcaacaacacagccggtcttttcaagaatagttttccggagatcgtgtgccagtgcatcaggatctgccggaaggagcgtgacatgcccttcaggtgcatttgatccgtcaacccctgcattcggaagaagatgtccagattttatggatagtaaaaacccgggtatcccccctacaatagcatcagactcctggattaccacttcagccagagccggttcgatgtcatactgcaaagctacctctcgtgcctcttctgatggctggatagattggagttcgataattctaccctgggcggttgcaaccgctgactctgcaaggacgatgatatcatgatcctgcaggacaagtccctgagtatcaaaggcagcatagagatgttccagcagggagtctccaggttttatgagtgcagtctgtagtccgaagatctgaaattgtctcattcctacctcatcaggtgcatgacactttttattacgtccctggtctccgggatgtcatgggcacgaataactgatgccccgttttcaattaatctggtcgtcacggcaagtgttccggcaagtcttccggttggtgactgaccggttaattctccaataaatgactttcttgagacagcgacaagaagtggcagattatatgccgataattcatgaaaatgcctgcatagttcccagtcatcttctgctgtccgttcaggtatccatttgccgatgccaggatcaagaattatatcctcaatcccctggtcacgtgcccgtgtcagaacatttctgatggagtcatgggtatcctttagagagcgggcatcacccggggcttttccagatgccataagaactgccggaagtccggcatctgcgatgagctttgccatatccgggtttgaaagcccggaaatatcatttgcaagatggatatcaaaatgaagagctgcattcaggacttctgggtgcatggtatcaatactgatgacagagtcctcaccttgcagtttgtgtaaagactcttttatccgggcagtctcttcagatactgaaatcggagggctgcccggtgcagtgcttcgtgccccaatgtcgagaatctcagccccgtcagcgatcatctgaacggcagtctcatgaaccgctgaaattggcacaaaagaacctggataaaaagattcgggactaatgttcagaacacccatcagaacagggcagggcctgccgatatgaatgccctttacatgaaatgtccgcatcgattccttgcaatatctgcggtgttttccataagtgatgcgatggtcatcggcccgacaccacccggcaccggcgtaatagccccggcaatcttctccacctcatcaaatgctacatcaccacagagttttccgttaacctggtttgtcccgacatcaacaaccgtcgctcctggttttaccatatcagcagtaatgatgcctgcttttccagcagcactcacgagtatgtcagcctgttttgtaatctccttcagattctctgtcttgctgtgacacatggtcacagttgcgtctgcatggagaagaagcagagcaataggacgaccgacgtctacactcctaccaacaacaacagcccgcttccctgctattgaaattttgttctcatgaagaagtgtcatgatcccatttggtgtgcagggccggggaccgggaagtccggtgaccagcctgcccatattcaggggatgaaatccgtccacatccttttcaggcagaatggctgcaagaaccgcttcggtgtcgatggattttgggagaggaagctggaccagtattccatcaatatccgggtcttcgttcagttgccggatacgttcaaggatagtccgggttgttgtgtcctccggcagggagatatttaccgaagatattcccacctgttcacaagcccggtgcttcatcctgacatacatatgtgatgccgggtcatcacctacaataacggtagcaagagttggggagaggcccccctcaataatatcttctttcagcagttcgagtctacgtgctgcaagtcctttaccatctaatatcatgtaagatcagggtagaggggatattggctggcaagagatttgacttcttccctgattgtttcctgaagtctggtattcttgctgtcacggatgattgctgcaatccattctccgatctgtttcatttcactctccttcataccccggctggtaacagcgggagttccgacacgaagaccgctggtgacaaaggggctcttggtctcatttggaatggtgttcttgtttacggtaatcccggcatttccaagagcttgttccgcctcaagtccggtaattccaaagttcgtcaggtcaagaagacagagatggttgtcggttcctcctgatacaagtctgacaccgtttgctgataaagtctcagccatcgtccgtgcattcttcacaacctgttctgaatattttttgaactcttttgtggatgcttccttgaaacagactgcttttgcagcaatgatatgcatcaggggtccgccctgcattccggggaatactgctttgtcaattggtgctgcaaactccttgtcacagaggatgaatccaccacggggaccacgaagtgttttatgcgtggttgaagtggtaaaggttgtcagaccgaccgggcttgggtggatgccggttgcacacagaccagcaatatgcgcaatatctgcaacacagtatgctccgacctcttctgagatttcagcaaaggccttaaagtcaatctctcttgggtaggcgctcgcaccgcatacaataatcttcggtttgatagttcgtgccatctcggcgatcgtgccataatccatccgctctgtctttaaatcaacaccatattggtgcgattcatagataatacctgaaaagttcaccggtgacccatgggagagatggccaccctgtgagaggttcatggaaaggatcttgtcacttggcttgaggacagtaaagtatactgccatatttgcctggctgccggaatgtggctgaacatttgcatgttctgcaccaaacagggaacaaaccctgtcgcgagccagattttctgccatgtcatggaactcacatccgccgtagtatcgtttacccggatacccttctgcgtatttgttcgtcatgattgaaccggaagcttcaaggactgccctgctgacgacattctctgaagcaataagttcaaggccgtttatctgacggttggtttctttatcgatgatcgctgcaatttctggatcagtcgtttccagataggacatgtgcatacacatctggcataaaagggtaatatggttttgtaaatccggataatttttccctgtcatgcggccagtttaagagaaaatgaaaaattgagaagggaaatatatatgtattagtatcaaatactaacacagacagattgccgggttatatcaggattgtaaggttatgagtgaagaagggtacgggacaaataatcttgatgaacgggttcgtctgctagaacggaaagtagcagacatggaagcgctcatcaaaggcctgactgatgaaatgctggatatgaaggcggtagttatgaagctgaaaaaggaacagcgaccaccaccggttatccaggcagttgctccaccaatctcccgaagcaaggttgagcgggaaagtcctgaaccggaggctgaaacggtaaaacctgtctctcctccgatacgggataagatcaccctgaagatgcagcctgatggtacattacagccggaaaaggagagcggtgaagagattatcattgcatccgcccgcgatgcccggatgagatataaagaccagcatcagagaagtggttcgaatgatctcatcattgcagaagataaagagccttcagaagacttgtaaatcaggaaaataattccctttccttgctctggtgtaaggatttgcatatcacacaacttgaaatagataacttcaaatcttttgggagaaaaacaaaaatcccatttttaccaggatttacagtaatttccggaccgaatggttcaggaaaaagcaatattattgatagtatcctttttgttcttgccctttcttcatccaggcatcttcgtgcagagaaactgactgatctcatcaatctgaacaccgatagaaataccgctgaagttgagatcaccttctctgacgggacgaatatccggcgtcgtatcaagagaaccgaaaacacctattataattatctgtatctgaatggacgctcctgcaggcagggggagcttctggactttcttgcgggtcatggaattgtcccccatgggtataatgtggtcatgcagggggacatcaaccgcattattgagatgagtgataatgaacggagaaagattatagatgagatagccggcgttgccgagtttgattcaaagaaagatatggccctttccgaactctcacaggtcagagagcgaatgaccgaagagtcggttcacattgaggagctgagtgtcaggcttgctcagctggagaaacagaaagaacaggctgtttcctatcggaaattacaggatgaactgaaatatctgacaatgtgccggtcagccgcacgactatctgcccgaaagaaggatcaggatgcacttctgcagtcaatagccgaagaaaaaagtcaggttgtacagattgaggcagatatctcatggaagtctcatgaacgggattttatcagggatgagattgcggagatagatcagaagattgccgccaggactggaagtgaatatatggctctggtgtccaggattgctgaggcaaaggctgcaattgatggattttatcgttcgatagatcgggccggacgagacaaggaggaagcgaataaaaggctttctgatgttttcacggatgtaaagcgacaggaagagcgtatacaggcccttgataccgaaatgcggaacctgatgattgaccggaccaatctctctatgacggcatctgcagtacaaaaggagtttgatcgcatatcgcaggcaatagcccaggagacgaaaggtcttgaagaagaggaggctcgactggaaaacctgcgttcagagattcacaaaatccgcgaagaacggggtgaattactgcatcaacaggatattctcattgaacggtcacggatgcgaagcgctgaagaagaccgccttacctcccgtataattgcgatagacaaagacatccgggagaaggatgaggatatcgcaggtcttaccacggcattatcccggcttaccgaagagaagaaagagcatgatcggatgatggccgctcttgatactgctctttatacgaaacgtgaagagcatgatcgactgattcgacagatccgggatcttaaagttgaaatcgggagaaaagaagcgcagcaacaggcccagggtcggtataatcgcgcgatggaagcagttctcgggatggacggggtgtatggcactattggagatcttgcaacctgtaaacctgaatatgcgaatgcactgactattgcagctggaggaaagatccattttgttgttgtagaaacagatcaaattgctgcggatgcaatccggtacctgcaggagcataaactgggtcgggtaacatttctcccattaaataagctcaggccaaaaccgcttccttctctgccaccaggatcagatgttctgggatttgctctggatctgcttgattatgatccccggtttgatgcagccttcagggttgtattcggttccaccatagttattgatacccttgaccatgcacgtaaacggattggttcatcacgcatggtgacgcttgatggctcgctgcttgaaccatcaggaacaatgaccggaggaagtataaagaaagatgccggcgggtttgggacgacatcggttgatgaggtgaagcatctttcatcccaattagctgctctgactgcagatgagcaggcactgtccgagtcattgaaagctgataccacagagcgtgattctgtacagagccggagactggaacttgaaggtgccattgtcagggcgaaaggacaattggaatctgcagaatcagcaaaggttaatctcctttccgagaaggattctcttcagaaacagcgtgaagcagcaggcgggggaggcggtggcagttctcttgaacttgcaacagttgaagctgcaatagaagagaagaatcagactcttgcgggaattcagaaagcgattcaggatatcactgatcatctgtcagaaaccggcattcctcaactctacgaacaacgtgaagaggcagaacgacagatcaccgagatacagaggaggctgcataataaggaacaggagatcaacgaaatccggttggagattgggtttgcccagaaaaaagttgaggaagaacgtcagcagatggagcgtatccgggaacagatgaaacggtacgaggaagagatacgcgagtgtcatgacgagattgcgaagaagcaacaggatatcaaggatgccgagacaacagtagccaagttctcccaggagatagaggatctccggtcagagcgttcattactttcaaacaaggcagactcctttgatctggagattcgcgagttttcagggaaaaaggatcgggttctgctgaaaatagagagtatggaggagaaattatctgctctgaaatcggaaattgcagagctggtaaccgaagcaggtgagtgcagaaccgatttaagtgaagaggagattgaagaccggtcacagaagacaatcgtcgccattgaacgtcttggggatgtcaatatgcgggccatagaggagtatgaacaggtccatgcagttgttgcggaacgaatgtccagggttgaaacgttaaaacgggagatgaatgatattcaggaacggatagaatttttctcaaagaaaaagtatgaagcctttcaggatgcgttcacatctatagatgccaatttcagggatatcttctcacgccttaccatgggttccggagaactcaggcttgaaaaccccgatgatccctttactggtggtctgtcttttgcagtccagccacgtgataaaaaagtgcaccatctctctgcactctccggtggtgaaaagtcgcttacaacgcttgcctttatcttttcaatacagaaatacatccctgcgccattttatgcatttgatgaagtggatatgaatcttgatggatcaaacgtagtgcggatagcagagatgatccgggagttatcaggaacgtcacaatttattaacatctctcttcgaaaaccgatgattgattctgcagaccgaatcctcggtgtgactatccggcctgacaagaccagtcttgtgaccggggtgagtatggatgattgatgatccggttgaaatcctggtaaagatggctgaacgcggggagattgatccctggaatgttgatattactgaagttacggatcggttctttgtcgagatggaaaaacaggagatgcttgatctccgcctttcagcgagaactcttctgtatgccgcaactcttctgcggatcaaatccgattatctgaaagatcgctcctggggatttgaggaagaagatgacgggggggatatccctgagagtccggacgatgatgttctgtcacggattcacaatccagtccagctgcttgaacatgagatcacgcgccggctggaacgaaagagtatgcgcaaacagccgattaccctttacgacctcatcaaccttcttcggaatgcagaaaaagaagagcgaaggcgacaacgcgaagtctggagttatgacgggctcgtgtatactgaagaagtcgtctcaatcgcccatgaggaagcgtaccaggagaatgccatggaagtattaacctgctgtgtggactgtgtgtctcagggcaggaaagtcactttatcggagattgcaaaccgtctgaaatggccggtcgttcatgtatttatcccgctgctcttccttatgcatgaaggatacctggagatttcccaggatacgttttttggcgaggtatatattgagcccaatccagccacgtatgcggcgattcagcatgcgaccggatcaggtatgatctgaatctgcgctctagagagaatagagacctccggagatcctcccggctcctgcatcggaagtataattccgaaaaaatatcttcataaaaccgagttggaaaatattgaccgatgtaacgcagatagagtgaatgtgatgaagtgacagaaatttttcttcagaacctcgttatctatatatgtgaattcgatcaactattgtatcccacacgcttcctgaaacatcaggagccggcggccggggaatgattgttcgggaagggcaatacgaaagtatataaccttcagcgagcaacgtaagaggccgttttaatggagacccgacgaatgcactttggtgcagtatcggttctgacataggaatactggtaatgtggatatctgtctgcatctgccaatactttaagagatacagtgtgcgagaaaaatagaaattctggttgatcctgccagaggccactgctatcggggtttgactaagccatgcgagtcgagaggtgcaagacctcggcgtactgctcagtaacacgtggacaatctgccctgaagaggaggataatcccgggaaactgggggtaatactccatagttcgtgctgactggaatgttatgcgaacgaaagatccgtcgcttcaggatgagtctgcggccgattaggtagttgttggggtaacggcccaacaagcctgtcatcggtacgggttgtgggagcaagagcccggagatggattctgagacacgaatccaggccctacggggcgcagcaggcgcgaaaactttaccatgcgggcaaccgtgataaggaaaccccgagtgccagcacaggctggctgtccaccagtgtaaataactggtgaagaaagggccgggcaagaccggtgccagccgccgcggtaataccggcggctcgagtggtggccgctattactgggcttaaagggtccgtagctggatatacaagtcccttgagaaatccgccggcttaaccggtgggcgttcaggggaaactgtatttctagggaccgggagaggtgagaggtactgccggggtaggagtgaaatcctgtaatcccggtgggaccacctatggcgaaggcatctcaccagaacgggtccgacagtgagggacgaaagctgggggagcaaaccggattagatacccgggtagtcccagctgtaaacgatgcgcgttaggtgtgtcagtgaccacgtgtcactgaggtgccgaagggaaaccgtgaaacgcgccgcctggggagtacggtcgcaaggctgaaacttaaaggaattggcgggggagcaccacaacgggtggagcctgcggtttaatcggactcaacgccggaaatctcaccggataagacagctgaatgatagtcgggatgaagactctacttgactagctgagaggaggtgcatggccgtcgtcagttcgtactgtgaagcatcctgtttagtcaggcaacgagcgagacccacgcgagcagttgccagcttgaccttcgggttgatggggacactgctcggaccgcctctgctaaaggggaggaaggaatgggcaacggtaggtcagcatgccccgaattatccgggctacacgcgggctacaatggacaggacaatgggtttcgacaccgagaggtgaggataatctcctaaacctgtccgaagttcggattgcgggttgtaactcacccgcatgaagctggaatccgtagtaatcgcgtttcaacatagcgcggtgaatatgtccctgctccttgcacacaccgcccgtcaaaccacccgagtgaggtcttgatgaggatgtatcagtgatatgttcgaatctgggttttgcaaggggggttaagtcgtaacaaggtagccgtaggggaatctgcggctggatcacctcctaacgaaatgaaagttgtggcagatggagacagaccatagagttatcagtgttccggaatggaatcagagggctcgtagctcagctggaagagcgcggcgtttgcaacgccgaggcctggggttcaaatccccacgggtccactggtatttttcgatgcacccggtctggcgacagaaccggggaagggcttgagaccccgtgaaaccggggcgatgatacgctgtgtagaggagatgcgtagagaaaatcactaggcgtttctggacgttacatgggtttgaagaaactacaaaaagacgttcttacgcctgtcagtggatggctcggttcgggtgccgacgaagggcgtgccaagctgcgataagctccgggtagacgcatggagtcattgaaccggagatccccgaataggacatccagatgcataaagcatcattccgccatcggaaagggaacgccccgaattgaaacatcttagtaggggcaggagaagaaaccaaccgggatgtcgttagtagaggcgatcgaacacgacagagttcaaaccgaatccttcgggagatgtggtgtatggaccgcggcataagatttgcattcagaactgaagttacctggaacggtataccagagagggtgacagtcccgtatgtgtatgcatgcagactttagcggtatcctgagtagcgtgggtcggaattcccgcgtgaatgtgggggtcatcaacctccaaaactaaatactccccgaaaccgatagcgtagtagtagcgtgagcgaaagctgaaaagcaaccctggaaaggtgttgaaaagtgcctgaaactgacaggttatcgcgtgatacggcacgaaaggatcttcaaagcgaaggaacgagttgcgagactcaagtacgggttttgttgccggtgtcgtatcgtacgttttgaagaacgggccagagagtttattctgttggcgacggttaatttctatgaaagaagccagagggaaaccaacaagtccgcagccgtaaggtcagggacgacgtactaccagtgcgtggagtcagcaggataagacccgaagcccggcgatctatgcgtgggcaggttgaagcgtgccgaaaggtgcgtggaggaccgcaagcggttttgatatgcaaatcattcgcgtgacctgcgtataggagtgaaagattaatcgagccgggcatcagctggttcctctcgaaacatgccgtagcatgacctgatctgagatcgacagtgaggtagagcactgattggggaagctggggaagaaattcctcactctcctgtcaaactccaaattccctgtcatcagcgacgatcggaagtccgcattacggggtaagcttgtaatgcgtaagggagacaacccagaccgtggttaatgtccctcagtgcaggctcagtgtaaacactgaaagtagtcctgggtcaaagacaactgggaggtgagcttagaagcagctaccctttaaaaagtgcgtaacagcttaccagtcaagattcagggcgctgaaaatggacggggcttaagcctgccacagataccacggaccatacgaattgtatgatggcgtagagaggcgtcctgcatgggcggaagcagggttgcaagatcctgtggaccgtgcaggaatgaaaattctggcagtagtagaagcttaagattggtgagaatccaatccgccgcaggggctaggtttcctcgacaatgttcgtcagtcgagggttagtcggtcctaagacgtaccgtaattcgagtacgccgaaagggaaacaggttaatattcctgtacctgtatcaaacaatcctgacgctttcggataggcattgcggagtcatcgctccgtctaagccggatatgaaattggagtaccgtaatggtgagaatttttcaaaacggtgatggggtaacaatgctgattccaggagcccgtgaaaagggtgatacggtccgtaccgagaactgacacaggtgcccctcgctgagaaggcgaaggcgtgtcgggagtaaatgtgttaagggaactcggcaaattagccctgtaactttgggataaggggtgcctgcccagcgattgggcaggtcgcagtgacaagatcgctccgactgtctaataacaacatagcagactgcaactccgaaaggactcgtatagtctgtgattcctgcccagtgcgagtatctgaacaccgggttcaaccggacgaaggactcgtaaacggcgggggtaactatgaccctcttaaggtagcgtagtaccttgtcgcttaattggcgacttgcatgaatggaataacgagagcgatactgtccctaacacatacccgttgaaccttttgtactagtgcagagactagtgactccttatgggaagtgaagaccccgtggagctttactgcagcctgtcgttgggttacggtattacctgcgcagggtagatgggagacgtcgatccaacccttgtgggggttggttagtcaccgatgagacaccatcctggttttattgtaattctaactgatttatcaggacatcgataggtaggcagtttgggtggggcgccacaccctcgaaaaaatatcaagggtgccctaaggtcaactcaagcgggtcagaaacccgctgaagagtgtcaagagcaaaagttggcctgacgcgatttcgcatagcaagaaatcgcgagaggaaactcgggtctaacgaaccaatacgccctgttgatgagggctattgactacagaaaagctaccccggggataacagagtcgtcgccggcaagagcacatatcgacccggcggcttgctacctcgatgtcggttctttccatcctggctgtgcagcagcagccaagggtgaggttgttcgcctattaaaggggatcgtgagctgggtttagaccgtcgtgagacaggtcggttactatctataaggagtgttggaagtctgaaggcaagaatgaaatagtacgagaggaactttcattcggcgccactggtctaccggttgtctgacaaggcaacgccgggcagctacgcgccaagagataaaagctgaaagcatctaagcttgaaactcagcctgaacaagagacttcatgaaagacacgggtaaaagacccggttgataggttcgggatgtacgcacgaaggcaacgacgtgttcagtccgcgaatactaatcgtcttaataacgtcaattcatgtttctcaaacccagacgaaatccttaaacgctggtgtaattatatctcgcatcttccacacatccaagccaggccaagtggctgagcagtcacgcggttgacagcaggtcaactcaattccggttcgaacccggagtttggctatcaatagcggccacagcaggtgtgtcacacccgttcccattccgaacacggaagttaagacacctcacgtggatgacggtactgaggtacgcgagtcctcgggaaatcatcctcgctgctattgttcaacgagaaaattctattgtaactgatttaaaagcacgaggcttaaccgggtcataccggtgttcagtttcaatagcggccacagcaggtgtgtcacacccgttcccattccgaacacggaagttaagacacctcacgtggataacggtactgaggtacgcgagtcctcgggaaatcatcctcgctgctattgttcaatgagaaaaactattcttttaggtttgtttcacgtattgattttgcaatgctttttactaaagaatcaatacaaaaattgatatctgtccctttcttctcacgggaaaacctcatatggttacctgatcctcaggttattgaaagtcatatgataaaatggtcagatgtttttcggatatgcagtatattatttttcgttggattgtcctgcagttactctgttattgcagcaaatacaagtgaaccagatacagcattcatggatttaacgtcttcaaaatctgtagttgaagttggggacaccatcctcgtcgagggttacattgtcccttcgttactatccagacctggagatcgggttctcctgcaggtaacctctccgaaagaaagcagggctgatacctattatcaattgaaaaccagcactgaaggattatttaatatcgagtttctggctgatgccattggtgactggagttttcaggcacgatatagtgaatatgcaagcccggtcgttccggttaaagtaaccccacgggcaaaagtgaaagagacagaacttaccatatctggtccttttaatcgtgtctttatgggagagtccggccagatgagtggctggcttcgggattatgaaggaaacggcatcccttaccgagaggtctggtattcatttggtcttccttcatacagttgtgtcctgtgtgaagatgatgcaaggcgaatctggcagacactgggacctgttactactgatgaaatagggtattttgaattcagttttcccgcccgtgacaagggaacgtatgccgtaaaagcatcattccctggtgatgaaatatttgcaaaggctgaatcagaaacagtatatccaaacgttctctgaaaatagggatagtccggttcatcccggaattgcatattttttctccaaagcatttgccccgaacgttgtgatggttaccagaagaaggtacacaatcgcaacggcgatgaaggtttcattgtatgcaaaatatttggttgcaataagcttgcttgcaccggttaattcaatcacggtgatcatataagccagcgatgaatattttataagataaataaattcattcgaaatccctggtattgaccgacgtaatgcctggggtaatacaatatttaaaatagcctgattctttgtcataccaagtgcttttgcagcgattaattgaccttcttttactgataatattgagcctctgatatattctgaattataggcactattgcagaatataaatcccagaactgaggcaacaaagggggtcagaacaataccaactgaaggtagtccgaaatacagaataaaaaggagcagtaataatgggcaacccctgaaaaatatggtgtatatgtgcatcagccaggaaagaccttttccaccatacacccgcccgcatgcaactccaaccccgagaagaaaaccaatgggtgcagtaatagcaacaagcgccagagttatgagcaggccatttgcaaaggccgggaccataatgtcaaagatgaaggatatctgatccatggttctgccttactgactatactccctgaattctccaataaatgccttacaccgttcaaatttaggattattcagaagttcagcgggagttccctgttccttgatatgtccatgttccataaagcagattttactggcaacagaacatgcaaatcccatctcatgagtcacgaccagcatggtcataccctctacagccagttttttcatcacttcaagaacttccctggtcagttcgggatcaagagcactggtaggttcatcaaacaacatgatgtccgggtccatggcaagagctctggcaatcgatacccgctgggcctgtcctccggataactctgcaggataatgatcagcccagtcagccatgccgacctgttttaactcaaacattgccttttcccgtgcttctttcgggtccatctttttcactttcaggagggcaatctcaacatttctgacagcagtgagatgatcgaacaggaaaaagttctgaaaaaccatgccgatcttttgtctgaaataatttatccgggggcctgcatgagtgacctcttcgtcattcaaaaatatctttccactatcaggaattgtcagctgattaatgcacctgaggagagtactttttcctgtacctgatgggccgataaaacagatcgtctcgccttttttgacatctaatgaaactcctttcaggacttcattttttccaaaggcttttttgatattttcaatccgtaaaatatatgtggtgtcagtcatgtgattatgatcctcctggtccgaaacctggtattgcaatcttcttctcgaccatatgaatgcatgaagttcccgcataactgagcagaataaaaattacagcacaggcaaggtaaattggcatggtaacgtaggtttgtgagacaatttgtgatgaccgggtgagtaactcggctactccgattgcataacagacagatgactcggttaatatctccggatactgattcgaccatccgggaagagcaattctcaaggcctggggtagaataatgcttttgattgcctgaaaccgtgacatacccagtgaacgagcagcgatcatctgaccttcggagattgactggattgctccacggaatacctgtgactgatatgctgcaccccacaaacccagaactactgctccaacatagaatgcaggtaaatccagtcctaatgcaggaaatataccaaaatagaataaaaataggagaacaaggacaggaagacctctgaaaaaccatacgaacgttgcaattgcagatcgtacaggaagtgatccatagacctgacccagagccaggggaagtccgactcccgccccgataataagggcagatgcgacaagacctagtgtcagtacaattccactgaaaagatatggaaaccagtcgattaaaatggataatgccataatctgttaaactccggccctgacatcatgatcttgcgggatgcaatcccttatagatccacaatagatggccttggatcttttataatcaataatgggtagtaagaaaagatgaattgatttattccatctcatacttcttcttaagctcatcccattttggagatgccatcagccggacaagtccttcattcatggtctcaagaagttcagtatcagtctttctgatagcaataccatattcttctccggtatcaatttcaccgatgatatgaagcggttttcctgcaatagcatcaagcattggtggccggtcatatattgcgaaatcaatccgcttattctgaaggtctgttgcaacgagtgggaaattatcataagtaacgagcatatctgcagtcattatactcttattgaccaggttgtcttcagcccagaaggcaccggtagtcccgcgctgtgctccgacttttcctgcaccagccatgaagtcatccatggtgaactctgagtcatcgtgaactgctactgactggtttaccttccagtatgggtcgctgaaattgacgacttctttccgttcatcggtgatggtcattccggagtagaccatgtcaatctttcctgcctgcagagcggggatgataccgtcccatgccatagcctgaatcttgacattaaagcccatttcatcggcaatccacttgactgattcaacatcaaatccctggggttccccatttttgtcaatgaaactgtacggtggatattccccgtcaatacctacgatatatgttggcttctcctcggaacctgctgctgtggcttccggggcgacaaccgcacctttctcctctgccggtttctccgtacatccgcacagacaaactccaataagaacaaagaatgtgataagaacagatacaacctttttgtccatcaacaaacgtttttcctgccattcatttatccgttttcatttggttttctttacctgaacaggtctttaaaagtcatgtggatacatcccgacacgtcctctgattcaattcctaatacatatgtatatgctcaacaaatccaacaatgatgaaaagaaaaggattggtgctggtctctcttattggactggttttgttattgttcatgagcggctgtacgactactgagcagactgctccatcatctgaagtacatgttcagccaactgaagaagtatcgcaagcaaaagaatctgttcccctttaccgggtaggtatagatgctgcatatcaaccattttcaatggtcggacctgatggaaaagcgaccggatttgatgttgattccatgaaatggatcgcaaaagatcagggatttgaagttgaatttttacccattgcctgggacggtataattcctgctctccttgccggaaaaattgatctcgtctacgcaggaatgaccattactgaagagagaaaagaaaaagtaaacttttcaaagccatactggacagtcaaccagatggtagttgtgaaagaaggatctccgataacattagaacaggtaaagaacggttctgttgtcatcggaacgcagcgtggatgtactgcagcaatatggatcgatgaaaacctggtaaatcagagtcttatgcccgcacaaaatctgaaattgtacgacaacaccccgctcgccgttgatgatctggtttcaggtcgtattgatgcggtgatgtatgacagtacggtcatgaatgacatcattgctggaaaacctgttgcaaagattggaatggttgagacgaatgaggatttcggcattgctgttcggaaggaagatacagaactgctggaaaagctcaattcaggccttgagaaactcatggcttcacctgattgggaagcactgaaacagaaatataaaatggagtaatccatttcttttttccgaatagcataaacctgatcatgatgaacctgtcaggaatattctgacacggactttatgcatcatgaattttcaaaaaaaagattatatccctctcctgtatgctatactatctgcgttattttttggaagttgtgctccggtaacgaaatatttcgtatcagatatcggtccgcttatgcttgctgctctcttttatcttggcagcgggcttggtatgtgttgtataatcaccggtaggcggataatcagacgaggagcatctcctgctgattctcctgtctcacggtctgacataccctatctggccggcatgtcatttttcggaggcattcttgcaccagtcaccctcatgtattctatggagattaccccggcagcaaccggttctcttctgttaaattttgagtcagttgcaaccgggctgatggctgcctttctcttcagggaagcggtgggaaagcgcatctgggctgcaatggcattcatcaccctttcatgtcttattttatcatatgatccaaagggaatatttggtttttccatcggggcatttggagttcttcttgcgtgttttttctgggcctttgataacaatatcagtcggagggtttcaggaaaagatccatttatgtgtattatgattaagggactttctgctggagtttgcaccggagtaataggccttctggcaggtgagatcgctcctcctctccttgaaattcctcttttcttactgatcggctttttcagttatggagggcttgccagtgtattcttcctgttggcacttcgttcaataggaaccgccagaaccggtttatttcttgctctatctccctttttcggagtattattctcctcctttctgttccgagaaccattccatgaggtctttttcctggcatttttggtcatggttattggggtatatctgctggtaagcgagagtcattcacatcagcattatcaccctccgctggtgcataatcatcgtcattctcacactgatcttcaccatgatcatgtccatgatccctatgctccaccggtctcttcttccgatgaacacagtcatctccatgcacacaaggagataacgcatgatcatccgcataaaccggatctgcatcatcaccatgatcataaaacctgatttgaggatcaggtctttagttctataaaaagagaattataagaacaatgtcatgcataattggcctgatacagatctctgtaagtcctcacaaatcctggaatattcagcatgccatggaaaacatcagagaggctgctgagagtggtgcacagataatctgccttccagaattattctcaacaccatattttccacaacatatcggacttgatagttccccatttaccgacacatgtgatggcgctacgatttaccggttcagtaaactggcattggaactgggatgcgttctgattgttccaatttgtgaaaaaagctcagataatcgaatatataatagtgcagtggtgattgatgctgatgggtcggtttttcggccatatcgtaagattcacatccctcaggatccgctcttttatgagaagggatattttaaccctggcgatgaatacagagtttataagacaaaatatgcaaatctagcagttttaatctgttttgatcaatggtttcccgaagcagctcgggaggtagcactgaatggtgctgatatcattttttatccaactgctatcggtcatatcaggggcgagatccccgcagaaggtgactggaaggagtcatggaaggtaattcagcggtcacatgctatcgcgaacagtattccggtcgctgcggtaaaccggtgtggctgggaggatgaactcttcttttttggaggctcctttatctgcgacgcatttggaaagatcctcgtacaaggagatatagacgaggaaattattcttgcagaagttgatctctcgcttggcccctcaatccgtgaagcatggggcttttttagaaacagaaggccggacacctatcactcactcactgctttggaaaaacccggatcaagcacagaatctctgacaccggcaaaccagggatatcacatgccggctgaatgggagcatcatgatgctgtctggatggcatggccatataatgatctgacatttccccaccttgaggcagtagaagagacctacctgaccattctctcttcactccgatcagaacgggttgaacttctcatcgctgatcccacctatcaggagaaaatcctacacatgctctcattcaggggtgtggactgttcacatatcaggttccatattgttcattactctgatgtctggatacgggatttcggtccgacatgtgtagtaaaccgggcccttcatgatgtatcagcagtattctgggattttaatgcatgggggaacaagtatgatgagctcattctggatggggtaaaaacccatgagttatttcagacccttggcatgaagatattcaggcctggtatcgtgcttgaagggggatctattgatagcaatggacggggatgtgttcttaccacacggcaatgtctcctgaatccaaatcgtaatccccatctcacccaggacgatatagagcattatctgtgtgaatatctgtgtgcaagaaagatcatctggttacatgagggtattgcaggagatgataccgacggacatattgatgacattgcacggtttgtgaatccaaccacggtagtatgtgccattgaggagaatcaggaggatgagaactatcttcctttacaggaaaatttcaggattttgtctaaagaaaccgatcagaataataatcctttaacggtcatcccaataccgatgcctcatcccgtgaaggatgaatcaaaccggtatccggcaagttatctcaatttttatattggaaatgaagtagttctggtcccggtttttgatgatgagcatgatagtcgtgctcttgagatacttcagcctctcttcccggatcgtgaagtcataggaataccggcacgagccatggttgaaggatttggaacgattcattgtgcgacgcagcagcagccttttgcatgatatatcatgcaaaggttctttttcttttgcggtggatgtatctctgatacaaatgacgttgatatctgaatttcttgattttttaaaagagtacaaagtagttgcccttgctatagcgtttatcatgggagttgctgcaactgctcttgtaaaatcatttgtagataacctgattatgccttttgtcagtgttatcactccttccggagactggaaagaagccgtcctggcgattggtcctgtccagcttggcatcggtccatttgcggcagaatgtattaattttattatcatcgccctggttgtctttatggtcgctaaatatgtgatgaaagaagagaaggttgaaaagaaataagaatgtcttttcaggattttgttcccgatgtctggtatatgatagcagggaggattgcacctcctctctgttgtacccgtcctgccccggttcatcaggtctttaaaaaagctcttttcgaggtctttaaaaaagagggggatattgatgaggcagttcgtcttcttcaggatattctattacatgctccacctgaatggatggtttttgatcaggcaggacaacttctgaatgtgatcgggtggcggaattcctatcataaagattggtttgaacctgatcggaaggttcattcatttaaacccggacggtgcggaccccatgttgcccatgcctatgctcttatgcaggcagcagtggatgatgaagcactcggtctcgtttccagaatcatctctgaaggagaacaagattcggatgacgttcatatggccagactgattcgtgcatcaatatgtatctgtcagggcagaattgaagaaggagaagaagaactcagaatgctctcctcttcagaaaaatactattcataattatttttactctgctctgcaatctcattacatgacatatgatcctcactcaaaatccggaacctccagacaggagattcttgatcttcttgcaggtcttgcaccacctgaacttgcagaatcttttgattccggaaggattggtctgattattgaaggaaaagaacatatcactaagatcagtacctgtcttgatgttacccctgcggttgtcagaaaagcaattgagaacagatctgatcttttgattgctcatcatactcctatctgggctcctttgacttctattggaggagatgatgccagacttttctcgatgattctccagtcggagatgaatgtgtatgtgatgcacacgaactgggatcatgcaccaggaggagtgaatgatattcttgcagatctccttggtctgactgagcgtgagaatatgtcactgggtcttgtcggtacctgcgtacgaacggtagaggagatggtcagaatattgaaagctcctttacggatatggggaaatgtggagaaggtacagagattagccattgccgcaggttcagggtttgatagtgcgctcatcagggaagcgcagtctctgggagctgatgcattcctttctgctgaacttcggcattcggtgtaccggtcatcacctcttcctcttctggagtcaacccattatgctctggaatctcctgcaatgcgcgttcttgctgaaaaacatggatgggagtacatcgacgatcttccggtgttgcactctctttcatgaaaagtcccatagacattctgcatgaaacaaacatacttgatgagcggatgcgcaagcgcatttccggatattatcgccatcggggagaaaaagcccttgaaatagtggatgatgaccgggtcaaacggtatcgtgatttctttgtggtggttggagagacgggggaatacgttgttgaggggaattattgttcatgtgaagattttcttcaccggggcaccgtctgcgcccatgtacttgcagtatgtattgcccgggcaattggcaggtatgaattgatagatctctggtattatcaggatctgaaagaacagggaattatcccatatagaatacaaacggatatctaaggcatcgcaggcaattttcatgatggaagatgaatatcaacttgaatattttaagtctgaaggtctgactcgtaacatttgttcctcgtgtggaaaggcattctggactcgtaatcctgatcggatggtatgtggggacgctccctgcgaaccataccaatttataggaaatcctatcttcagagcgaaaactgtagatgaaatgcgggaagcatatctctccttttttgagaagcaggggcatacccggattgaccggtatccggtcgctgcacgatggcgtgatgatatctatctgacaattgcatcgatcgcagattttcagccatttgttaccagcggcgtagtgcctcccccggcaaatccccttaccatctctcagccctgtatccgtctcaatgatctggattctgtcggtcgttcagggcgtcacctcacatgctttgagatgatggctcatcatgccttcaactctgatgagaaagagatctactggaaagatcgcacggttgagctctgtgatcagctcctgacgtcacttggtgcaaataaggagatggtgacctataaggaacacccgtggattggaggaggaaatgcaggtccaagtgtggaggttttgataggcgggcttgaggttgcaacgttggtgttcatgagtcttggaaagcagaagactgaaaagcctcccattgaacttgaaggaacaccctattatccgatgactcttcggattgtcgatacggggtatggacttgaacggtttgtctgggcatcacagggatcacccactatttatgatgctgtatttcccgagatggtcagtcatgtgatgcaggaggcaggatttggtcaccggctccatgattcggacttcattcatattcttggagagaatgcgaagttcgcgggtcttatggatatatctggccagcggattttcgagctcagacagaaggttgcagaaaagatcggcataccgaccgacaaacttgagaagatgatcgcaccggttgagagtgtctatgcgatcgtggatcatacccgatgtctgtcctacatgcttggagactgcattgttccgtcaaatgccaaggatggatatcttgcaagactggtgcttcgaagaacactccggatgatgcgggaactggacctgcctgacgaaaaactgggggatctgatagagcgtcagatgaagattattggtctttcaaagtttgagcaggatccagatgtggttatggagattgttgaccgtgaggttgacaagtaccggacaaccatggaacggggagccaggacagttgagcgtcttgcacagacatataagaagaagtgcgaaaagattccgcttgatgagatcatcacgttgtatgattcacatggcattcctcctgacatggtaaaagatcttgcaacttctcagggagcggttgtagatcttcctgatgacttttactcacggattgcgaatatgcactccgaatcagagcagatccaggagaagaacccgctgtttgattatctagatcggcttgctcatcttcccgaaaccaggaaattattttacgaacggcccggatcgatggagtttgaagcgaaagttctggaaatcttcgatggtcagtatgttgtcctcgatcagactctcttttatccagaaggaggaggccagccaggtgacaccggtttgttcctgacacctgatggtctgacggtcagagtctgcgatactatcaagcttggcgagtcaattcttcaccgtatcgatggggggaatgtaagaaaaggggacatgattcgtggtatcctcgatgaggatcggagattatctctgatgcggcaccacaccgcaacccacattctcctccatgcggcaaaagaagtgctcggtgctcatatacatcaggcaggtgcccaaaagggtgaatatagttcacggattgatatcaggcactataagcacatcactcctgaagagcttaaaaagatagaggttgttgcaaaccgcctggttatggcaaacagctccacctccatcgcctgggaagatcgtactgatgcagaacagaaatacggtttctgtctgtatcagggaggtgtacctcccggatcacggattcgtgtggtcaaggttgccggtgatattgaagcctgtgccggaacacattgtgcccatactggtgatataggaaccatctctatcatccgcgttgagcatgtacaggatggagtggagcgtctggagtttgccgccggtatcgctgcaatccagcataaacatcatcaggaagatcttctgaaccgatctgcagaggcattttcagttcaggttgaggcactcccggcaacatccaaacggttctttgatgagtggaaggagcagagaaaggagattgaaaaactctcttcacgcattagtgaattggagagtaaaaaccttgagactgttgattataatggaatttcagtccttgtgaaacggcttgatcttccaaatccggaactggtcaaagttgcgaccggtatctctgataaaggtgggattgccatccttgtcgccgggggagagacagcccgggttgtagtgtcttccgggcagaaaggagtaaaagcgggagatgtcatatcaacagtctgcgctgtacttggaggaaagggcggaggaaaaccgacattggcccagggcggcggtccagatgtctctaaaattgatgatgctcttgctgcaggtgagagttttataaaaagcgctcttcatgtctgaagaacctgaaaaagacagtgtacaaaaagtccggctgctctctccggatgatgagcaggcacggcttatcggaaaggccatagcgagtgagaccgccgggaagatcctctcatccatggccggacgggaagtcactgcgatgatgctgtcagaggaacttgaaactcctgtctctacagtcatgtatcatctggaaaaccttgcatctgctggtcttattgaggtcagcagaaccagatatagtgtaaaaggccgtgagatgaaagtgtaccggcttattgatcaggttcttatcgtatcaccgaaatcatttgatttaaaagcggttctggcaagatgtgcaacactgctttcaattcccctcgcacttgcggttctgcttacctcattcactctgtttcattctcagaaggccgccccgctttactattctgcgccagcaggcagcgcccagaagatggagtccaatattgcctcttatgcagcggatcggatgatggagatggcacccgctccaacagttgctccattagcgggtcccacccagtggttggaagaaattgaaacgccatttccgcacctgcccgaatttgcagagggaattctcattggggcagtgctggtaattatcatcggtctcatttttgatttctatcgaaaaagataatgatatcatcccctttttttgctcatggagcgaaatgtgtaatgttttgcagaaattttccggaatataatttccggttcttcagattatctgatagttgataagatggacggttctgacctgcctcagtatattatcggattatttgccccagaatggccgacaccgggatgaccactcatgtatattgctcctgacattccaggagatgatagtgttgggaatattggcactatcgaaatcctttaaatctcatcttttctttccggtaatcaggatgaaacataagagacttagaattcctgcaaggatccctgaagatgcctgtgttttagtcggtgaaggaataactggtgtttcagggatggttgttgcaggaatggttgttgcgatcgtctcaatagtaggcgccggagtaatgatttctgtctttttcgtatctgctccggtgatggtaaactggtactctccgataaaaccgttcttatctgaaatacttgccacgtactccccgggtgacggtaccggaattgttgttgaaaaatctccggaattatcagcaaacccctttttagtaattacttgttcgggcccgtacgtaaagtcaccaggtccgaagacacggatagtaagtactccgtccccgattcctctcattcttccgcttatcgttaacgcctgtgagagcggttgtgtaactggggatgtgatggaaatctcgtcagatctatctgtaatctgaatgattcgtctgacaatagaagatgaacccagttgtcgctcgacaaacatttcattgtctgatacgatattatgaacttctaccttgtattgaccacgctcaaggtgtcgtgtatcaaagtctacacgaaaggtttgagtcttatcaacaatcacccgtgttctggcaacctcacccgccgtatattttgaatagaaaagaaccagatcaaaataggaatcctctggaaatgttgttgttccggtgaccaaaaggggacttcctttaataacagttttcggcgtatcaattgtgatgatatatccctgcacaataccggtggcacagatgagcagggcaaggcagatgaaaaaaaacaggtatcgtttcatatatagaattctgatcatcttctatattgccataatggatggttttattcacatgtcattgcataaaatccacgtattgtatgggctatatcttcaccaaggacctcagcaattcgcatgtccaatactgaataataatccggagaaatacaatgcaggctctcttctcccgtcataacaagatcgatgagatatctgagatcatccgcacttaaccggtcaacccgtctcctaaaatcctctgcgcttgttgcataatgatttgcgaccggaggcagaatcgatcgatagggcatccccgaaccattgcagatttccccggagaattcaggagcgagaacctggaggagttggatatcgcgttcagatagttcacgaggcatgaatactaatcgatggctcatcctattattcctgtgaaagtagtattgcactcagaactaacagataggcatggttgtagtaccctggcaggcacgtcttggaatccttctggtgagttgttctgctcttgtgtatctcacaaaacttaccgtgattgacaatatatcaggaacggttgagtatatcttcaactcgttcggttttttgttcatcaatgtcctgcttgttacgttggtcattaatgagcttctttcacgtcgtgcaagaaatgcccgtcttgaaaaattgaacatggttatcgggattttttttaccgaagtcggaaatgaattgttgaaaaggattattcaagctgatcctgaatcaacagcctttgggtcttcatttgttctccagggaaaagagcatcctgatgagaaagctatggaaagagtggtatctgatcaccgttttcagattcaacatgaaaagatagattttaaggaaattcaggattttctacaagaaaagcgcaattttctattacggctcatggaaaacccggtcatgcttgagcatcagagttttactgcgctccttcaggcagcatttcaccttacggcggaacttggtcatcgtgaagttattgaccgactatctgcatcagatcaggcacatctggcaggagatatcagcagagtatatcgggcactcgcttatgagtgggttcattacatgggatatctgaaccggaactatccgtatctgtattctcttgccgtcagaacaaatccgtttgatccatatacccgtattgaggtgacctgaatcaggaactcaaaaaggtaaaaaattttcatgagggggatgtaactggtggtgtatagactcttgtgccaagttctttatccagcatataaagaaggccaacacctttctcctggctgatcatttggagttgatccaggatcgtccgtgcattctcttcctcctcaacctgttcatttacaaaccactgtaaaaaattcaccgttgcatgatctttttcggtaatagacaaattcacaaggttattgataagactggttacttttagctcgtgagccatctgtgtctcaaaggcatcttttgcatccctccactcagtttgcggggcttcaatctgctgcattactgcacgaccaccgcgggccagaacataatcgaagatctttaatgcatgatcccgttcttccatggcctgaacccgttcccaattggcaaatccacgaagtccgactgagtcaaaccaggaggacatcgagagatacagatatgcggaatagagttctgcatttatctgttcattcagtgctttttcgacttttggattcatactacccataggagcagcagttccttttacctttgggggcatgtgtggtgattagacgtgttcatattttaagatgcaggtaggtgggttttctctgataatctacttccttcttacttctctcttaaagactttccaaatatattttaagagtgacggaaggaaagggattatacggttcacaaagaaagataacatgttcggatttaaccggaccatctcatccggtgcagatagaagtctgtgctcagggagaagttaccatgaatcttaaacgtcctaattccaatgaggcggtcgggactgtaaatcgctcacgcgatgttgttccgatgtctggcatgtgttcccgttgtgtggacgggtgtaaaggtgcctgcgatgtatggcttgcatcatttcggggaagagaagttctgtatcccgggccttttggtgaggtcactgcaggggcagacaagaactacccgattgattactcacatctgaatatacatgggtatgcctgcggagcaaacgggcttccggatggcgttgcagcaaatccggatactgctgtttttgatgatgtcaacactgaaactgattacggctgggacattaaagtaaagatgcgcgtacccatcttcaccggtgcactgggctctactgatattgcacgaatcaactgggagcactttgccgttggagcagcaatttcaggaattacccttgtctgtggtgagaatgtctgtggtgtcgatccggaactcaagctgggatcagatgggaaggttgtctcctcaccggaaatggaccgtagaatcaacacctacaaaaagttccacgagggatatggagagcttctcgttcagatgaacgtggaagatacccgtcttggtactgcagagtacgtcgcttccaagcacaaccttgagactattgaactgaaatggggacagggtgccaagtgtattggtggagagatcaaggttaaaaacctcgaacgagcccaggaactcaagaaacgtgggtatatcgttcttccagatccgacccgggctgacaatatcgccgcatttaaggacggggcaatcaaggaatttgagcgtcattcaagacttggatttgtatcaaaggaaggtttcctggaggaagtagaccggctgcgtggtattggctttaagcgtgtaaccctgaagactggtgcctactccatgaaagagcttgcaatggcgatccgctggtcatcagaagcaaagattgatctgctcaccatcgacggagctcctggtggaactggtatgagcccctggcctatgatgaatgagtggggtattccgaccttctatattcagtcccttgcctaccagatggcagaggcattaaagaagaagggaatgcgtgttccagatcttgccattgctggtggatttgccgatgaagcaaatgcattcaaggccctcgccatgggtgccccgtacttcaaagctgtctgtatgggtcgtgccctcatgatcccgggaatggttggaaagaatattgagaagtggatcaaggatggagaacttccaaagaccgtctccaagtacggatctaccatccctgaactcttcgttacttacgagaccctgaaagagaagtatggaaaccgtctgagtgagattccggttggtgctattggtatctacacctatgcacagaaattcagaaccggaatgcagcagatcatggcaggcagcagaaacttctccctgaaatctgtgaacagaaatgatctgatggcccttactccagaagcagcagaagtttcaggtatcccctatgtcatggaatcataccgcgaccaggcctgggatatccttcttgaataaaattaaaccgataaaatccctcttttttctaacattccctgaatatgcggggatagataaatacttctttgatagaatgaaggtacccgtcttcttgatcctgcctgtctgaaaattgtccggggagaattgtttggaagattcttgatatcattccggaaccagtcatttatccattccctgtagaagatattctcaaataggctattattctctcaaagccctggagatcttgtatgccacagatctattcggggactttgaaaaccaaaaataagaatgtgaggggtaaaggggataaaaattatctggattttttattttcaggataatatgacgggtttcacagggagaagttttctggtatcagggtaaagatatatatgatgaggttctttaataccgccggaccggtaaattgtgagaaacattattgtctcccacctcttagccggtttaatctgccagaaatacttactctcattagccaggagaagtattttgttctccatgcgccaagacaaagtgggaagacctcctgtcttcttgcatgtgctgaatacttcaataaagacgggcggtaatatgcactctatacaaatgttgaagcaggccaggctgcgagggaagatgtcacgttagcaatgcgggctatcctgtatgggatgcttcagagaatggagattcaatttccaaatcttatctcatctggggaacttgagcagataattcttgataatggcccgtttggtgccatgacaaccttttttacagattgtctaacagactggataaaccacttatcctgatgatagatgagatcgatacacttgtgggtgatacattaatttctgttctcaggcagattcgatctggatatgatattcgtccacttcattttccatcatccatcatcctctgtggagttcgtgattttcgtgactatcgtatccattccgataaagacaaatcagtcatcaccggtggaagtgcatttaatataaaagcagaatctttacggttaggtaatttcaccgaagatgagacaaggacactttttcttgaacataccacagagaccgggcaggtttttgaagatgaagcccttgcctcagtctggaacctgacgagaggtcagccctggcttgtcaatgcccttgcatatgaggtctgttttaaaattgaggggggaaagaaccgctccaatccaataacacagtcccttgtcatggaagcgaaagagcgacttatccagagaagggagacccatcttgatcagctggtggataaactccaggaagaacgagtccggagagttattgaaccgatacttaccggagagatatttgaagagaacctgaaatctgatgatatttattaccttgtcgatctcgggcttataaccccggaaaggggaggagctctggcaatttcaaacccgatataccaggagataataccccgggaactcagttatactgcccagtctggtatgtctctgaaagcagcatggtatatcgataagaatggaagcatccgggtccatgatctcctggtctcattccaacaatttttccgggagcactccgaaagctggactgaaatcgcccagtataaagaagctgctcctcaactcatccttgaggcattcctccagcggatagtgaacgggggcggtcagataacacgggaatatggcttgggcaaaggcaggacagatcttttcatcctctggtgtctgccagatgggacataccagcggtttgtcattgaatgcaagatagtatatggatcccgagaagccaccatcagcaaaggtcttgatcaggtgatgaggtatgctgaccggtgcggagcagaagaggtgtacctgctcatatttgaccgggatacaaagaagagctgggatgagaagatttttaatcaaataatagagcatcaggggaggaaggttacgatatttgggatgtgaccgggggcataactatctctctctaaaaaaatgctatcagactattcatccaccggtttttaggtcaactccttatggcctttacgaaatagagttactttggtccccatatctgacacttcccggcaattacgacccaggcggttgtttcaccggagctgagaaacaataatgagacaactcgtcgataagccgtattgcaacctggtatccaagttcaggttcaagggattccagccatatataaaatcctaccttcggtggggttttccgttcatacttgaatgtcccctgaccatcaaagaccattttgtaatactccttcttctgccttggctttaagtatatcagagggctgtaatcaggaatatcggccgcaagaatgatcttagaaaattgggcctgcagatcatctgcagtatactccttatcccggtatacaaatctgtaccgctcacacaatcgtttggcagttgagggaaaaagtcttccaaacaggatcttctttaccagtgtatgtgtccggtatggtgagggaagatcaatgattccttctccgcccagatgggtaaatacccattcccgctccaaatcatgaaattgtttatagggaaaaggtgcggcggtattcaaatcggtggataaacaggtcttaccaaccggcaggaaaggtttttgtgactgtttattccatgttccggcgatatgttttctgaaattatcacatgaacgggtgcagagtgagatatgctcctctgatccaaggacttttcgtccccccttgtaatttgtcaggggaaatgaggttacgaggatgaaggttaccgctttctggttaaacaggtacctgatcacctgtttcttataatatatctcctggaggaaatccttcaggtcagagggagatgtgactacctcaacaaaaatgaccgatccatccggctttgtcatcagcagatcaaactctgcaagatcctggccatttcccctgatggtgatatcgccattccgtgaataaaaaaagccattctgaccaagggcagggtagggatttcttcccttcacgtctgctcctttgaggacgacggtcttgatggcatcggtcttgtctgcgatgtcaagaaagagctcataggcgatcatctcaaaccaccgcccctctgctgatcgcatataggatatttcgtcagaaaagagatttttcttctcaagtcgcgagagatgccggagtgcccgttgagcatgttctcttcgcggctgacataatttatgatgagattctatccattgtgcgagatcatccattattccctgacactatcctccatattctgtttggtatggtattttactaaaaatcatcctgattatttttctccagtaggggagacggacaattcctttaaaactacaccatgatgacagatataagttattcccgcgcagcacctgatttttaatatcctgtatcatgaggacagatatccctttctcatcggtattatgcataagcaatcatgaaaaaactgagcaatatttatattgtaaaacatccttctaatagtgctacagatcagtgactaacggggttcgtagctcagttaggcagagcgcctggcttttaaccaggtggtcgggggttcaaatcccctcgagcccgctccacgacagttgtggtcttttgtgcagactttttaccgaaacgcgtttccagggggtatggcgtgtccgccgagctgaacgtactgaaacatgagatggtaccagaacacagtatcatgagcgaagaagatgtaaaaaatctttatgctcgataccagatcggacccgaacaattgccgaagatttatcatgatgatccggcagtattgtcaataggggccagaattagtgacgtaattaaaatcgtccgaaaaagtatgactgccggccgagcagaatcctatcgtctggtagtaagacgacccaaaaaataaccttccggggctgatctgttgattgatttaagtatactttctcaggcttacttttcccgtgaacatgtagcccgtcaccagctggactcatacaatcattttcttctcaacaatctccagaaggtcgttgatgagcagcgggtaattgagacggatattgaaacacgggggaaagggaatgaaccggtctctgttgaacttggagatctgaaaattttaaaaccactggtccgtgaagcggatggttctcagtccgaactctatcctggtgaggcacggttgcgaaacatcacctatgcagcaccgattcagcttgacctgactcttgttcagggaggagtcagacatgagccggtgactgcaactatcggacaattaccgatcatggtgggctcagttgcctgcaatctgtatggcatgacagatgaggagcggacttctcatggagaggatccccttgatccgggtggctattttattgtgaacggtactgagcgtgtgctcatgacgcttgaagatcttgcctcaaacaagatcatgacagaatataccgagcggtacaatgagcgtatctacgttgccaaggtgttctcccagtttcgtgggtaccgtgccctggtcgttgtagagcggaaccgcaaaaacctgcttgaagttaccttcccgtcggttgccggtcatcttcggtttgttgatatgatgcgggcccttggtatgaccagcgatgctgatatcgtccgtgctgtctcaaccgatgaagagatcctcacgttcatgatgcagaatcttgaggagagcgaatgtgagaccgttgaatgcggtgtcatgtacgtcgggaagaagctggcacccaaccagactcgcgattatcagcgcaaacgtgcagagtttgttcttgataattatcttctgccacacctcaattacctgatgccccgtacagtgaacgaagaggatgaagagtgtatgaaaattgtgcattctgtccggcttgcaaaggctcatttccttggccggatggcagaggcatgttttgatctggttcttgaccggcggcgtattgatgataaggatcattatgcaaacaagaggctcaaactggccggtgacttaatggaagacctcttccgtatctctctgaaccggctgacccgtgatgtcaagtatcagctggaacgtgccagcatgaggcaccgcgacctctcgatcgccaccgcagtccgtgcagatgtgctgactgagcgtctccttcatccgcttgcaaccggtaactgggtcggaggaagaactggtgtgtcacagctgcttgaccgcgttgatcacatgagtgtcctttcacacttacgcagagtcatatctcccctctcccgttcccagccgcacttcgaggctcgtgatctccacccaacccagtggggtcgtatctgtccaagcgaaactcctgaaggaccaaattgtggtctggtgaaaaattttgcccagatggtggagattagtaaaggcgtccattcagatgaagagattattcggatgctctatggtatgggtgtagagaggataggagttgagatttgatgatttccacacagtcaagagtgttcgttgatggagcacttatcggtctggtagatgatccgaaagctcttgtaactcaaattcgtgccttgaggaggcagggtgtcatctctaccgaggtaaactgctcgtacaaggagtttaacggcgatattatcattcacaccgatcgcgggcgggcacggcgacctcttattgtgcttgaaaatggcgtcccgaccattcctgaagaggaaattcaaaaactgaaaaataaagagatagagtttgttgatcttatcaaaaagggatatattgaactgattgatgcagaagaggaagaagacctgaatattgcaatcaaaccagagaatatcactcctgaacacactcatcttgaggtagatccctctctcatcctcggtatcggggcagctcatgtaccattccctgagcacaatgcatctccccgtgttaccatgggagccggaatggtcaagcaggcactgggatttggttgtgcaaatatgaagctccgacctgatacccgtggtcaccttctccactatgttcaaaaacctctggtatatacgcagacttctgatgttatcggttcagatgaccgggctgcaggtcagaactttgttgttgcaatcctctcctatgaaggctataacattgaagatgccctgatcttcaacaaggcatcaatcgaccgtggtgtcggacgttcacactttttcagaacatatgaaggagaagaacgccggtatcctggtggtcagattgaccgtattgaggtccctgacgaagacgtgacaggagcacatggatctgattattatgccaaccttgacgatgatggtatcatcaatccagaaaccattgtcaaagagaaggatgtcattatcggaaagacttctccgccgcgtttccttgaagaaccaacgtctgagctgattaccgtagaaaagcgccgtgatacctccgtgaccatgcgttccaacgagcatggtattgttgacactgttattctgaccgaaggagagaacaactccaaactggtcaaggtcagaacccgtgatctccgtattccggaagttggagacaaattcgcatcacgacacgggcagaaaggagtcgtagggcttatcactccgagtgttgacatgccgttcaccgcgggcggtctgactcctgacctggtcattaatcctcatgcaattccgtcacgaatgactatcggtcacatgcttgaaatgcttggtgggaaggtcggctctcttgaaggacgtcgtattgctggtacagctttttccggagaacgtgaagaggatcttcgtgcatcactgaaaaagttcgggttctcacacaccggtcgtgaagccatgtgggacggtatcaccggaagacgattccttgcagatatctacgtcggtgtcatctattaccagaaactctatcatatggtctcatccaagatgcatgcccgttccagaggtccggtccaggttctgaccagacagccgactgaaggtcgtgcccgtgaaggaggtctgcgtttcggagagatggagcgtgatgttatgatcggtcatggagcagccatggccctgaaagaacgtctgcttgaagagtccgacaaggtcaccgagtatgtgtgtgcacggtgtggtatggttgccatgctggaccggaaacagaatattacccgatgtctcaattgtggcagcgagactgatatctacccggttgagatgtcgtatgcattcaaattactccttgatgagatgaagagtatgaccattgctccccgtctcaacctcgaggatgttgtataaggaggagagaagcaatgccaagtcctaaacggatcgggaagatcgagtttggtctcctctccccgaaagagatccgacagatgagtgtcagaaagatcatctgggcggatacgtacgacgatgacgggttcccctatccccagggtttgatggatctgcatctgggtgtgattgatcctggtctccggtgcaagacctgcagtcagaaagcaggtgagtgtcccggacactttggtcacatcgagctggcaaagccggtcatccacgtcgggtatactcggcttattcgaaaactgcttcgtgttacctgcagagagtgtggccgtctgcttctgtctgatgaagagatcgagaagatcatcggaccagaagaagagatgggaagtgactcggtcagtgagaaggatgtgaagaaggagcgtatctgtccgcactgtggtgagcagcagctgaagatcaactttgaaaagccaaccacatttgccgagatcacgaccgacgaacggggcaaaaaagtagaaaataaacttaccccggcagatatcagagcacgtcttgaaaagattcctgatgacgacctgcagaaactgggtattataggcagcgtggcacgtcctgaatggactattatgaccgtgcttccggttcccccggtcaccatgcggccatccattattcttgagaatggtcagcgttcagaggacgacctgacgcataaactggttgatatcatcaggattaaccagcggttcaaggaaaaccaggatgcaggagcaccccagctgatcattgaagatctctgggaacttctccagtaccatgtgacaacttatatcgacaacgaggtcgctggatgtccgccagcacgtcaccggtccggccgtccgctcaagaccctctcccagcgtctgaaaggaaaagacgggcgtttcagaggaagtttatctggtaagcgtgtgaacttctcatcccgtaccgttatctctccggatccaaacctctcggtcaatgaagtgggtatcccccagaagattgcgaatgagatgaccattccggttcaggtcacggtttttaatatagatgaactccgccggattgtcagggtcggacctgatcggccaaacctcaaatccccctgtggtgcaaactatgtcatcaggcctgacaagcgtcgtatccgtctggtaaaaggtaccggggcagatgacgggaaccttgactttgttgccgatcagatagacgttggatggattgtcgagcgtcatctccgtgatggtgatattgtgctctttaaccgacagccgtccctccaccggatgtcaattatggcccactgggtccggcttatggatggcaagacatttcgtctgaatccggcagtctgtcccccctataacgcggattttgatggggatgagatgaacctgcacatcccgcagaccgaagaggccagggttgaagcagccatgctcgcagcagtgcaggagaatatcctgtcgccccgttttggcggaccgatcatcgggggtatccatgaccacatctccggtatcttccttctgacccacacactccggtggtttacgaaggaagagaccatcgatcttctcaaaaataacaagattgatcgtctcggtgaaccagggaaagtagaggatggcgtgaaatattggtccaacaagcagatattctcaaagatcctcccggcagatctgaacatggtattccgtgcatcctcctgtaagggctgtgatgaatgccagcgggttgattgtgaacgtgatgcatatgtgcagatcatcgatggtgagttaatatccggtgttatcgataaaaaagcggttggtgcattcgatggtgcaattctccaccgtatcatcagacagtacggatatgaacgagctgcacgcttcatcgatgacatgacccgtctttcgattcgggcaattatgcatgacgggtttacctttgctatcgatgacgaagatctctccaagagcgattatggccagattcgtgaagttcttgaacgtgccgcccaggatgtggagcgtcgtattcagatctttgaggatggccagctcgaacccatgcctggcagaactccggaagagacccttgagatgcagatcatgcaggttcttggaaaagctcgtgataatacgggagagattgcaggcagacaccttggtctgtcgaattctgccgtggtcatggcggtctccggtgccagaggttcgatgctgaacctgacccagatggccggttgtgtcggtcagcaggcggttcgtggtgagcgtatcatgcgagggtacgaggatcggacccttccccatttcaagaaacatgaccggggagcaatggctcatgggtttgtcatgaacagttacaaatccggtctgaacccgactgaattcttcttccatgcaattggaggtcgtgagggtctggtggatactgcggtccgtacatcccagtctggttatctccagcggaggatgattaacgctttgcaggacctgaaagtagcctatgatatgaccgtcagaaccaccggaggcagaatcatccagttcgaatatggtgaggattctaccgatcctatgaagagttcatttggtgaaccggtggatgtcgaaggaattgtgagtaatgtcctcaaggaggagatctgatggaagagttgatgatcccctcagaagctgcagcagcagttctccggtactttgaagagcacaaagtcaagaaaaaattcccagatgatgttccggaacatattcgtgaagtgctcatcgagatggttgagtaccggatgaaggaagaggatgaggaggcagaagatactatcgatgaccagatgtttattgccaagatggaagatctcatccatgcagagaaattctatgactggctcgaagagagtttctctcctctcgtggtatcatcagatgatgatgagtcgataatcctccctcagaccatcattactcccacagcccgtccgcgacttactacactggataaaaaatcaatggaagtcagggagcacttttctgactaccagatgactattgagaagattaactccatccccgagcggattgagaagatccttaaggatagaataaaggatatcaaacgccaggaaaacccgaacttcaggcttactcagaaacaatacacggtatttctgaccaatcttctcaaaaagggcgattttgaagactgggtcatgcagacctttccgcttccagctgacatggagcaggaagtcttcacggtcaggaaggctgttcctgaagaagagattaagattcctgactgggtcgatgcagcggcatttgagggcctgaaccggtttgagcaggataaattccgcgctttactccgggatcacctctcttccctgaatgaacttgtcgaacacccacaagttacccagcggatgtccaaacggttctttgagctgatagccataggtcttccgcaccggaccaataccactcttgccaagattatcatcggacgtgagattgagggtctgactgatccctcccggattgtaacagacgagcagtatgccaagattctcgcccagatggtcaaggaatataagcacaccaggatagaaccatgtgaagcggtcggagttgttgcagcccagtctatcggtgagccgggtacgcagatgacgatgcgtactttccactacgcgggtgtggctgaaattaacgttaccttaggtcttccccgtctgattgagatcatggatgccaggaaggaaccatccaccccgaccatgaccatctatctccgtgaggggtactcaactgaccgtgataaagcgcggcaggtatcctggcagattgaggcagctccgcttcaggagtttggagatataaccactgacatggcaaatatgcagatcgtggttcatgtcaacaaagcggtctgtgagaaacggaagatatcagtcagggagatccttgagaccgctccaaagaagatcaaggaacgaagacattatcgtgattttgagtttgagacgaatgagtctgaagggctgctcatcttcatccccaaggatcgggggagttatcagaacctgttccagctcaaagaacatgtccggaatgttatcgttcagggtattgatgacattgaacgtgtagtcgtcagaaaggagtccggagaatacattctctacaccgaaggctccaacctgaaagatgtgtttgccatccgtggtgttgatacaaccaggaccaggacgaacaacataaacgagatttcacaagttcttggtgtcgaagccgccagaaatgccatcatcaacgaagcacttgcgactctctccgaacagggtatcatggtcgatgtgcgccacatcatgctcgttgcagatatgatgtgcatggaaggtgaagtaaagcaaatcggacgtcacggtattgccggagagaaggaatctgttctttcccgtgcagcattcgaagtgaccgtgaatcatctcctggatgcggcagtggcccatgaagctgacatcctctgtggtgtgactgagaatgtcattgttggtcagccaattcagcttggaacaggggatgttaaattagtagtaaagcagaaagtataggggtatctgatatggatttcaatacatctctgagacgtgcaattaagactgggaaggttatcctcggtcagaacgagacaaaggacagcattgagaagggatctgcaaagcttgtcgtcgttgcggcaaactgccctgcagaattttccggttatctctccggtaaggatggagtaaagacgtatacctatgaagggtcaggcgtccagcttggtcgtgcttgtggtaagccctttattgtgagcgcactagcaatcgaagagtccggtgactctgacattcttaccctttcccggtaacgaggctgcatgggagtagtcctgaatgaagaaacaatcgcacttatcgcccagtttgaaaaaatcacaggggcaggaagtcgcgatgttattgatgatggtgacgatgaccgtctcattttcattgtaaatcccggcgatatgggatacgcgattgggaaaaaaggcgtcaatattaaaaaagcatcagaatctttcgggaaaaggatagaggctgtggagtattctgacgatccggcacagttcatcaggaactgcttccatccggcccaggtgaaagaggtacagttttcagattatcatggcgagcagatcgcccatgttgtcatccgggatgaagatcgtggccgtgcaattgggaaggcaggaaaaaacctgaaccggaccaagatgctggcattaagagaacacgatattcaaaatatcattattgaataaccggacagcatcttacttttttcattcataatcttgaaataggtggcagtaggattcactcatatggctcttcatatgagaacatggagatgggtcctgatcggtgcaacactggtcctgattttagccggattttcatcagttgcatgtgatactggggatttcccggtccccgtcacaacggttcagcctcctgcaaatctgacggtatcagttcaactgaatcaggaagggaagtatacaaccgctattttcagaggcgggcatggacagagattacttaaggaaatacaggtcgaggtaattcacccggacgggtccaaagactcaggagtaatcggaaatgttgttggtgattcggtcatgctcaaagggtcagggtgtggcgaccaggtaattgccacagccaattttaaaaacggtatgagctatgtcattctgaatgagaagatgcagtatatccggggtatctgtcctgcagattattctccgactgtggatccctgtgaagagattgcccgttctccctcattgaaacctgatcctgttcaggaaattcctgtgaacaaatctgtagtcatccaggcaaatgtcgatattagcagaattgaggttcagttcaggggtggattcggtcagaatatgataaaaactttacaggttcaccggatcggtccggacgggtcaaaagagacacagagccttggaaaaaacatcggagatgaggttgtttttaccgcgacaaataattgtatggacagaatcgctgcagatgtgtcatttattgacggtacaatgtatcatttctatgataaggtcattcgtatcagtcgatacatgtacctctaaatttttttaaaaacgagcggacctggagggattcgaacccccgacattcgggttagaagcccgacgctatatcctggctaagccacaggcccaaagatgtgccttattttatttccaccagtaccagataatagtagcgtatgaataaagaggatggtgagtttttcaccctgcatggtacgcaaccggcctgaccacatcaacaattcttggttcggtaattgaacatctggtaacatttgcacgaatggtggttttcgagaggaatttgagcttcacccgtgcagcgagtttttcgcgctccatgatatgatatcctgaccctgattcaacggtatgtttcatggtaattgcaacggagatgacttcagcgataattcctgtatcaccgacagtaacatcttcgcaatcaacagttgtcagaaaaatgagtgaacctggtgtcacctgcgtcagtgagataacattatgtgcactggtaagttcaatagtccgtggaataccttttttcagttcttcgataacctggggaaaaatcccggtaagtgcaatacattccatggatatcacccatacatcggcagttgcggttctttcctgactggttgctcttcagcggtctggacatcttctgccagtctgtgcatctgcgcttcaatttcttcagcttgttcaataaggcctgacgtttcaatctgcagattatacagaatattcagtacatccaccgtttttgcagcagccctgggatctggtgcattgatcgtctctcccaaaaggccaatacccggtatccctcgtatcttacactcggtgagtatactgctggcaataccggaaatactaccaatagggagcctgattgcagagtcaccaagtctgtccagaaggggtttttctgtagcaactgagaaaacccgcttttccggctcatttgtaataataccagccaacgttacgacttctgatacattataaggagcgagccagtcaagaatggcatttgagacttcgtaacatatttggggatgaataggaatgtcggcaagaatagcaacaaacttacccttttcataaattctcaccggaacagcaatgacaccctctgacatcattgccattggcgggaaatatttactggtcattgtcccgatggaatcaaacccgagtttttcaactaaataagagagcgcaatacttcctacaagaccacttcccggaaatccgatcaaaattgcggacccttcggaagtgaggggccgggcctgaacgagaacgtcaggtatctggctgggggtcatatatcaaaataggagaaagaagaagataggtctgtcgcagcaggatgaggcacatatcaaacggtacttaaccctgcaggacgtacttttcttactactgatgataatgccggaatacaggtggtatctaaaaacggtaaaaacaccgattttaatctatctgcttctcataatgatcctttgtttgtccggttgtgtccggcctgaagccggatttaccgttcgtccggaatcattcaggcaaccacctgatgtgtatgcaaatgaaagtacatcagatgtaattctgtcagttggagataccatgatggtttcatacccctggacaccggaggatggcaggtactggcgtgtctcagtaactgagggattatttgtcactggcgaccggtacactccctttccacccggtattccagttgaagtctccggaacccgggaatggatggtgtgtgcaacctcacccggtattcagacttttgtcggatatctgcgaccgagaaatttgtcatggaatctggaaactatccagcataaaattaccgtaacggttctgtaagaaaatatgatcttatgaaaagaatgagaattggagtcgctggaaaattattgctgataatggttctgctcaccagtctcatcttcatcattatcggcggtatatcatggattgtgatggggaatctgggagcctatgcaacacagtccagtcttgctcttggggaacaagccataggtgagagcacaaccgctctggaagaggatgcagagatctatcttctccggcttgtaaaagaccaggcagagatcaccgatatggtctttgaacggatcatttccgagatgaatgtcctcaatgactatggaaaagtgatgatcaaagaaaataatgtgactcctgttacgtggtatacccgtgatataaagcccgcaaaaccaggtgagacgggtatcatccatctttctcccggagtgacagcagaacacgttctggatgaaatcatggcactgagttcattccagcctgttttcaatacccttttccatgcagataaccggctcactgcattgtatgttacctcttcttcagggatcaccttcatcttcccctggactccacgagttgatcctacctttgaaccacgatccagaagctggtttttggaagcggtgaatagttcgcaattcgtatggtctgatccgtatgttgatgtcttaggaaatggtcttaccatcacctgttcgaaggcagttcacagtcctgataaaacccggacatgggtcattggttctgatattactattgaaacgattaactaccggattatcaccacccagcttggtgaagacggatatgcatttctgataaatcagcggggggatattctctccagacctggtctgagcgctggagagaccaggtgggataagtcatacgagacagagaatcttcttcagagtacgaatgaagatctcagaaaggttgcagaagagatgaccaggggtctttccggtgtcagtcggtgcagatttgcagaaggtgacaagtatatcgcctatgcaccggtaaaaagtgtcggatggagcattggccttgtcgtaccggtagaacaggtaatcggacctgctcatatcaccggttcagtcatccgcctggcaagtgaagaaacccattcacacatcaccgaacagatgtcctttttgcaaaaaatccttattacaagtttctttctccttttcatcggagtgacgggtattgcaatattcttctctaaaatcattaccggtcctgttatgatactaagtgaaggggccagacgaatcgggaatggggatctgcagactccggttgagatacatactggtgatgagtttgaggagctggccggcgcctttaaccggatgacaaatgaccttcgcaattatattgtagaacttcggagaaccaccgcagagaaggagcgatttacgcgtgaacttgagattgcccagggaattcagcagagtttccttccagacaacgttcctgatattcctggtatggaacttgcggtattttcaagcccggctcttgaagttggaggagatttttatgactttatcccggttggtgatgatcagtgggggctggttattgccgatgtgagtgggaaaggtgttccagcagcactgttcatggcactctcccgaaccctaatccgggtaagtgctacctggaaaagctctcctgcaagtgcaatcactgaggcaaacacgcttatctgtcgtgactccaaggccagtatgtttgtaacgctcttttacctggttatcgactcaaagaaacggcagatcacctatgttaatgccggccataatcctcccctgatgttgaccggaggagaccagagtgatataacccttttaaaggctgaagggatcgcccttggaatcatcgatgatattgaccttgcttcggtaacggtggatttgaagaagggagatatggttgcgctttatactgatggtattaccgaagcgatgaacaaggatggagaggagtatggaatagaacggtttactgaggttttaatgcagaaccgtgaccttgatctttccgcactcattaatgcaataaagacatccatcaaagagtttacaaaagatgctccccagtcagatgacatcactcttatcctcttcagggcagtctgatcctttatttttccatcggaaattgcaggatgatctcttcatcaccaggctttggtaatttcacaattttccccccggcatacctgacggttcggagaagggcccgtgaaagaggaagctcgggtttccagtctacaccgactggcgtgattgcgatatgaacgaaatctttttttggaaaaatctcaacattgacactatctgcaccatacaatcggtaataatcggacaatgcactatagatatctgataaccggtcgacatcggcatatatgaattgaacagtatccggagttttgatagagaacctgatctctttgcagttttggtactctgcaagtctgctcagcaatatatttcgaaaactggtgacatcatcgatagaatgcaacaggtcatcatcactgaatgcacaagagttctgtttcaatataagatcattcaggacgtgtaccggatcacattttttgagtctcgcagtcggaatcactccctgcatggcagataaaagatctgagaatagtctggtagtccgacgaaccagggagggatcgatgaggtgctcaagagtatgtcctgtaagatatgacctgatcttttgaagtgtctgcaaagatttcaggataacctgtagctcggagagttttttctcttgaaaatctttgtaataggttgtaaatccatcaagggttttttcaatatcatcgacaggtatgagacgttccaggtcttctgcggtttcaaattcttcaagttcttcaagatggtaccgaaggagcatgattcttccggcaacaataggaaagagtcggtatgcctcatccataaggtccatagcatgtctcatggaaagatttacccgccctttgtcaaaaagggcaacatctggtaaggtttcatgagattgcttaagattgtgaagtatttttcgaaactccgacacgctgaatgcattaccatgtcccggacagatcactgaaatttcataattctcaagtatccattccatcctttggagcgttttagaaaattcaatggtgtcccaccccagaatccctgcaactccgggattgagtgcaaaggggatatccccgacatgcaaaagatttccaatacggatggccatactgtcatatgaatgccccggtactgcccagaaaaacagtgattgcccgtcaggaaagcgaagctcttcagaaagcaggaggatttcgtccgaaatgtgtatgttattgggaataagctgaaatcccggtaaaatttccgaaatttccagatcctggtttttattatggaaaagcgggagttctatctgaaggggcggtattggtaaatccaccagataggcctgggtatatcgctggtctcctgttctgataatatctgcaccagatgcatgacagacaaataccggctttccaaatttttcaaatcgccggtctaccaatccctcgtagatgtgatcgtagtgcgcatgcccgaaaatgatgatgagtggtttttctctgtcatatgaacatgttactagagcatcacatgcagtgtccataacttcctgcgacgcacccgtatctaaaaagacaatattatcccctatagtgagtagatacacattcgagctggtcacgtcaggttttcgaatacagggaaagattctggcatgagccgtaccaggaacatcctgccatcgttcattctgcagaatagcctgtttcgttttcacgcattgatctcgctttcacaaatcataaattcctagcagagaactgattatactaggacttgtgtcattatacatggagaagataggataatggaagatcatctttcaatacaggaacgtgaaatctccggaattactattctggatatatccggaagaatagatgctgcaacttcatcacaaattgaaggagagctgggaaagaagattgataccggggttacgactcttatccttaacatgaaggatttgagttatatcagcagttctgggcttcgggtaatactcgcagcattgaagcgggtcaaggccgaagaagggaccatcgcactcgctactctacagcctggtcccggagaagtttttaaaatgacaggatttgaccggctctttccgataagtccatcggttgaacaggcagttgaaaaactcaaatcgtaattttatgtctcgttcgaatatgaatggcagtatatcagattaaccttgaagatgcgatcactgcagtaacacaacttgcagaattcctctctgacataattgaaaaggagagcatttcttttgaagttgaaaatgcaatgcaactttctgcagaagaagcagttgtgaacatcatcacccacgggtataatgggaaacctggaatgatcgaagtgacatgtgaaattgcagatggttttgttacactcacgatctgcgatgaggcaccgcattttaatccgttaactattccgcctgcagatgttgatgcaggaattgatgagcggcggattggcggtcttggggttcacctgatccgctcactcatggataaagtcagatacaagcagactgattccggtaattgtcttatcatgcaaaaggcattatcatcctctctttcctgacagcagaaaccatctgaagaatggtggcatagttgtttgggtacacatgacccaatcctatgttcatggatattctgaacgtgaagctgaacgactgtttgatcaggctgaaacgctgacctgcctgattcaccatgactcaatttttcctccgggcagtaggatacttgaagccggatgcgggaccggggcacagacctgtattcttgcgggtaaaaacccccgttgtgagttcgtttctgttgatatttctcacacatcacttgcaattgcagaaaagcgggtgagtgctgcaggtctttcgaacgttaccctgcagcatgcagatattctaggagatgaactcccatttgggatgtttgaccacgcggttttttgctttgttcttgaacatattcgaaaacctgaagaagcaatccgccgtgtcatgaagatggtaaaaccaggtggcacggttactgctattgaaggggatcatggatcggtttgttttcatccggagagtgaaaaggctctcatggccatccggtgtcaggtccttcttcaggaacgagccgggggtgatgcctgtattggaagaaaactctatccgctgctggtttcatcagggctcaccgatgtcatggtttcaccacggctggtctatgctgatggggggagacctgacttagccacgggatttactgagaagaccttcatagccatgatccaggggatcagagatccagcaattgcggcaggtctgatgtcagcaaaagactttgatgaagggatatcggatctgattcgatctgcccaaaaagacgggacatttagttatacattctataaaggacgtggaattaatccctgaaaattgattattaaaaaaaaagagggcgcgcaacagcattctccacaaatgctttaagtaaaattgttttcctgaaaacaatgatccaaaatcactggataaacgaaaaccataccattagcttattaccttattgagttgacctaaagagacatggatcggattgtaacgttccttctcttactggtttcagcactcctgctggtaccggggtgtattgcagaagaacaggtagcacctgaagcaactgaagttgttccagaagtcccggttgtggaagaagcaaccgaagaagtcgttgaagaagttgcaggcgaagttcaggctgaggaagtaactgaagtcgtcgctgaagaacttccggtgtacaatgtcaccgctgatgtaaacagcactgaaatcaacatgactgttggtcagattgcaatgatcgaacttccggtaactactgactttgagtggaatgtaactgcatcagagggtcttactattatcaaggacatccatgtcgatgcagttgacgaaactgtcggcgctttccaccagtggtttgttgaagctgttgcagctggagaacagtctttctctggtgtagaaaagaaggcagattcagaagagactggcagcgaatacactcttaaaatcctcgtagagtaaatttcatctattgtcggataaccccgacacttctttttgttccagattacgtttttattgtattgttctgcaattcgtgcatacgatcaccttattgggttggtatgataacatgattgatcatggatcggattgtaacgttccttctcgtactggttctagcgctcctactagtaccggggtgtattgctgaagaactggctgcacctcttgcatctgatgttgctggagaagtcccggttgcagaagtaacaactgaaaaagttgttgaagataccaccgaagagactaccgaagaagtcttcgcatacaatatctctgctgacgtaaatacgactgaactgaatatgaccctgaaccaggtagcaatgattcagctttctgaaaatcctactaccggcttttcatggaatgtaactctttctgatggccttacccttctgaatgacagatatgttcaggatcccacaccagaggggatggttggtgttggtggtatccatgagtggtacgttgaagctgttgctgcaggtaaccagacttttgatggtatctataaacagccatgggaagaaacggtgggcaatgaaacgacctattccctggcgattctcgtagagtaatgataggtgaatatcagatgagttccatctctttttttgtgagttgactattaggcaggggtttgcaattcgaacacaaagaactgtgtatgaagcccaaaaaagaagagattcaggattctgatatgactggagttcccttttctatcgctctgatatggagttcaaccagttcctgcatccggggaacatgaaactgatctgcaatatcctgaattgcctccagcagatgcactgattcctcgaggtaactcaggatatcggcaggatagatctcaatcccaaactcatctcgaaggtactgactgatctgaatatgatcaagtcctgattcccgaagctcaattatttccttgacaaattttcgttcaggacaaccacaaaacgggttttcctggcatttgcaggagagaaaactcttgataaacgccactatctgttctcgtgttgaccgatcaaatgagtcatatggcacggagagaagcgcctcaagagttgcaccatgaaaggctccttctgggagtcgaaacccaattaattttccgatctgacggctatagcgaagtcgtgcacgggatgctatcatatatgctccaaggtaatgaaagagaatcaggatcctatgtaatgatccttatgaatcgtgtatgatcgtttgttgtttattgatatatcatctgttacaggtatataatttcagaatgttctgtgcataatcgtctgaaaggaaaaaaatttatgatttttcagatgtcagagtctccggatgagatagtaatctgattacatctcccatcgctctatatttcttgtctccgggtcaaatacaattccgacctcgtaaattggtcttgaatctgatcgatacttctctgcatatccccgctttctgatctgctcaagtggactttcatccccactcttatcgatcccaatgactttgaactcaaatatccagattcctgatctcgtcttcacggtgagatcaacccgccctttgttcgatgtatcttccggaataacttcgtatccaagacttgcaaaataggtgtataccacactggcataatacccctcatatctggcgatcgggttgtttctgtaccagtcatgtggaatggatgcaaagaacgaatgaaaacaagaatgtaaccgatcactatcctcttgttccagtgcatcatacaactggtcacgaatgccgaaggaatcacgtccgattaatgcctctgaaaagagatagttcagtgatgacctgacttcggtgtttggataaccaaggacacagcgaaatccccggattggatcggaggtccacgattttattgttagataacctgcctgaaagaggagtgtttcagttctgatgtattcaggatcaaaggatcccaggaggtcatcaccggcgataaggccttcgtattctgctggaaggcgggggtgtttcttccagagggctatgagaaatgaaggggtgcctgtctcaaaccagtatggtcgaattatcccctttgagaagaggagaagaatatcaaacgggttgtaaacagattcgccggtccatgaatacccatcataccattcacgaatctcatcaacatcaaatttcttgagatattcagaaaagactgtttcaagatcatgctgagtgtagccgcaaatagctgaatatggcctatcaagggtgatgtcattcagattattcaatcctgagaatattcctgttttagcaaatttcgaaacaccagtaagaagaacaaacttaagatggatatcaagtggttttattgctccatagaaatttttcagacaatcccgcatctccttcacgaggctgatatccccgatattatcaagaatcggtctgtcatactcatcgatgaggatgactacctgtttcccggttttttttgcaatttttggaatgagtgagaggagccggacaccgggatccccgctgcttttatcgatctcataatattcctcccattcatcaagggtagtagttaatctggtaatgagatcggagatctctttgagtgtccctcctgcaaaatcaacccgaagaaccgggtacgttgtttcaaagtcccaacccgcatctggagaatcgaggtataacccggagaagagttctttccgtccggaaaaagcacaatcaagggtgtcaatgaagagactctttccaaatcttcggggacgtgaaagaaagtaatatttccctttcgcgaccagttcggagatgaacttggttttatcgacatatgcatatcctccggttctcatctctgaaaatgcctgaatgccgattggaagttttggaagagacatattgctgagaagagtagggcttggagaactgatgattcttacggatgttagggtaaaaaactccggttccttcgtatccgtcttcagatataggcccttggttatcaccaatttttgtgtgtgttattcaaacagaaggaaggatcaatcaatgagggggttggtatgtatcaattaattactgagaagtatggaatttgaggatgctgtgtttttcagactctgacaattctgacatcacatttttctgcggtttgtgcctgccgctcatcactggtgatcaagagttcacctctggcgattgcttgtgatacaaaaagcagatcgtagaatgaatgttcgaattctatcgcaatgtggagtgcctccggatcatattgctcattcggttcgatagttattcaacagcctctgaaaaaatatatttacgaaacctcgcctgcttcctcgtcaaagttcttgagcgttcccatggcctcattcatagtctcaatctgaataagccattcatcaaagacgcccatatcctctgagtccttaatatatctgccacagcaggatttgccattaatgacgttcgcaccgatctccgcagctatcgcgagtagttcttcggtattctcctcatcaatactacgtcctttcttgacaagagccttgatatcttcgtcatagccaccttccaggtattttttggcagaggcaaacaggacaagtaactggaagtgcatgggggctatgagttcaatcatatcctcccctacctcctgttccatgatgatctcctctacctcgatgagtttattcatcgattcctccttcgaaaacctgttgttctggtagagcttgatgatcttcaagacttcaatacagatatcctgattaaaaccattcaacaactggtatccttcaggcatatcatcatcatcgccaccctcaaaatcagcctcacgcagggagtttatccagttatcccatcgctcctggctgtaaaagatatagaagagcttcattggagcttcttcctgcgctgatgccgattctttctttttgcgtggagccattacatacacctgtgattgaccgggcataagagtttgtcggctgcatggcatgagccggtatactacccagcctttcaacagccatttcaagacagaaaataaagtactgacgagatggagcaggatacccgcaaggtcgtgatggtccggttcggagaaatatttttaaagagtgaaccggtgcgcagggagtttttaaacaggctccgggataatatccgtgccggtctgaagggactgaacgtggaagcgactataacgatcacccggagcaggattctggtcagttccgaatcccccgtagatcttgtacccatgctctcacggatttttggcgtcattgatatagctccggtaacggtctgtgggaatagtatggatgatctctgtgatactgcgatccaggttgcacaatctcatctcatgccccatacccgattcgcggttcgggctcggcgtgaaggtgttgagggtttttccagccaggaacttgctgcagaagcaggatcccggatcatagatgccattcctgatctaaaagtggatctgactgcaccggagtatgagatctttatcgaggccagaaaagatgggagcatggtgtacgatacccggatatccggtccgggcggccttccttatgggacccagggaaaagcggttgctctcatctctgccggaatagactcaccggttgctgcctggttgatgatgcgccggggtgtccgcatgatcttccttcatatcgaaccgggaaaatttggtggagaagatatcagacgaaaccttgaaaacaaccttgccgcactttcacactgggttccgggtcttgaattacctgtcattaccatccctgctgagccgttctatcaggcacttatgaccctctccgaacccaagctcaggtgtgttctctgtaaacgtggcatgctggaactggcatcacgctacgcacaaaaatcaggctgtgatggtattataaccggagataatcttggtcaggtagcaacccagacccttcacaaccttgctcccatctctgccggtatagagatcccaatctatcgtccgctcatcgggtatgataaggaggagattataactcttgcacgaaagataggatcattctcatctgaaccaggggacacctcatgcagtgtcctccctccccggccggttaccaggtcagatgtccatcagattgagaggcttatggaacaagcatctttagggtccgtcatcgaagatatcctaaaattttcatcgataaaagtgataaaaaatggaatttttcagagtacctgatagtattaccgtgagcagaccagcccttctttctctgctatttcaatgaatgactctgcaatataatcagcctgttcactggtaatgccataactgttaaatttccaaaccctggtagatcctggaaggattcctgcaataccccgttcacgaagagcactggtcaggaaaaaacccttctttttatgtgtcttggcaacggtgtcaaatgaatcggttgtattcatcctggtgagggtatgtttccgggggtactcgctttgaacttttgttccttctatagtaagcagggcatcgacaatccggtttacgtattgtacctgtgcatcaaattctttcacccttctcttcacatggggaaatgatgccatcatcccgaccgatgtaacgcccatcagagtacatcccatcatctcaacctcttttactccgaatgtcctgccggtgagatctcccttaataccggtcgtcctgaagaccttctctgcccattcgctggttgttgcaagaacaccggatggagcaggagcagccatgcttttatgaccagaaccaacaagaaagtctgcacccagctcttttccgtttacatccatgataccgatcgtatacgctccattacacaggactggaatatcatattggtgagcaaccttgctgagatccgaaaccgggtgctggtttccatactgatagtcaacctgctcaataaacatgagggccggggttttcccggttgtcttaatcacttcctcaattctggctgctgctgcgtccggggttatgatgtgtgattcatcagcaggaatttcaaaagctgttccctttgactgttccacagataaaaattccgtgtaatgggagtacgctgtcaggaggactggatcacctggttttaccatggcagaagcaacggcctgaaagcctcttcgtgcaccgggcaccagcctggcaacatccatgttcagaaatgaagcaagatccctatgaaattctgccagcgggggcttggagatatgatcaagtctgaatggcttggtacagtgatcgcagactgaatatccgtcaccatatgccaggactgccttcatggcatcggtggtcagtcgtccaccggcctgaattggatcaaggttgataaaaagctcatcaatctgcctggaatcgatgccttcaccacaattcatgccagtaactcctccttcaggatagtgatctgtttctcaagtttcccgaggatcttttgagggtgttgcaccaatgatcaatatcatgcaggatcacaaatgatcgatctctaccccttaagctatcaaccaaaatagactaattgatgtatgaacctgcatgtatcaattcccactttacatactgtgtttgcaaaaatataggaaaaacctgaacctcttgacggttttataatattcgtagcaaattctttaattttaactataccctcaaatctgataagtttttttatattatgcactaatgcagctaaaaagaattctccctcgcaattctctttccctttttgagagaaactcctaaacctcatattatgtttcatattaccaaaaactggttcgaccatgtattttcgttttcgatataactctctaccagtgggggatttcacacgtacttccataactcgtttacaaatttcctgagttgttgcttgtttctctctgttcataaaagattgccaaacaaacgtcccgatactttgcaattccggaaatgtgattatttctcccatacaaatcgcccgacatatcatttccattcgtgagatatacccatcattatctgaatattctggaatttttctttctttagaaggagggatgatgagttgaatgccataatccaattctgctaaagaattcgggtatgagaaataacctgcatcagatagtagtatattaggcgaaattgatggatgaatacccgtaaaaaggtcttcgagttcatttagcataggtattaataattttttatcgttttgctcatctgatatcattgcagcgaggataaattgattttcagaaacgataatctgcccattatacccttgaatccagccattggtggttgacattatctgactttcaggatcagtgagatttacttttgaatctgaagatggctcttttttaggctctaaaggctttctacctcgtttctttttacccgattctaattcttctttttcgcggtccagaatcttttcttcttgttttttagattcgatatcatgtcgttcaattaatttctctttagcccgattaagaacttcctttcgtttttcttttgttgaaagatgctcaggtagtcggttaatctccatatcctgaatatttatatcatcgttttctaactcatcaatttcctgtgattcatcaaaaagccgacctagctctgcttcaaggtattttaattttttattggctgataaagaggcattacagccaaattttgatccatcgagggctaggacaccgattcttgctatcccggattctacgataatttgagataattgtttaaaaagggatttgatttcttttgaattattcttcttgaaacgatagatcgttgtatggtcaggtgtaagattattggcgacgatccgatatccaatatcataatggcagcacatctcaatttttctgctagatttttctccacgaatcattgaataaattattattccaagcattgaacgaggatcaaaaaaggcagaaccgcgaccatcgtcacgatatttattaataaatggactaatatcgagaatcgaaagaatttctaatatgccataagtaatatcattttcagatagccagtccatcgcattgacagggagtaaaaattgttgttcattaccatatcctctaatcatgttatagcgatgagacatataatatattgatcttaataatatatataattaagctttaataatttatattaagctttttttgtgtttgtgcaacagcctcttttcagcctcctttttttgttcaaccgataactgatggtgcgggactgtatcccgaagcatacctctgatatccgtaagaaggtagagtccctgaaataccgcatctactgaccgtttagacatatatgcacctgactgtacgattggttccgtgatgcaataagaggaacgattcggaaaagatgaagtggtgcggatcttttaaaaaaataaatctatgaatcagcttcagagactaatactgacagtcctgcttcccttcgaggactttgccccggcaacatgtctgtgttttcgggttatagcaggtatcgccacacttctgggatcctagaccttcaaacacctgtttctgacaacatgattgtgttttcgggtcataacaggtgtctccacatggctgcagaccaagtccctcaaatacctgctcctggcaacatgtctgtgtctttggattataacaggtatccccacagggctggtatccaaaaccatcgtagatggtgcccttgcaacatgactgactgcctggatcatatgttgagcctgcacagaacatgaccccctttccatcatacaccttcccctgtgagcagaactgcttttcagtatcataacaggcattgccgcattctctccagttcgggccttcaagagtcttgttattacagcatgactgggtcatcttgtcataacattccccgccacatgctccccagtaccggccatccaggacctgaccattacagcatgactgcgtgtccgggttgaactgcactccatgacaggtcgaaagacaacgggttccgtttaccgggtatccttcacaacagacctgcttctcccggttaaaacagacacccttacactccccccacatcaggccatcatatatctgacccctacagcacgactgtgtgcttggatcataacagctgtctccacatgggacaatcttggttttatcgtcatacacctgaccctggcagcatgtctgggtagcaggatcatacataccggttccacagggtatgactgcagcatatacgcctataatgagcgccgataaaagtatgagaacggaaaacatcataccaaaaaatcggatatggactttctgcatgatatcttgtactgcttcacagttcaagtatcttcgctcatgccggctactcactcttattatctccctgagatgaatatcttttcagatcatggataaccgatttcatcttctgaccgggacagatgtgctttcttacacctggattctcccccccggagaaatgattgctgtaggagaactggcggtagtcacggatgaacgaactaaaacccgctattttgcacgggttacaagaatgaatcatgaaccggagacaggtgggctcctggtaaccggccttcccatcgggtgcatcagtctggatggggaatatcgaaagccacgaaccatccctgcgctgtattcaccggtcagacccctggatgcagatgaaaatgccatactccgcaggttcatgggagaactggaagtcgggttcatgatgagcggaaaccagaaggtggttgacctccctatcggtatcccgtcatcagttttaaaccagcacttgggagtatttgccacgaccggtatgggaaaaagtaatctcatgaaggtcttctgtgcctctgcaatcaatacgcgaaatgcaggcatactcctcaccgatccgcatggggagtatgcaaccggccagccaggcgacccggactcacggggtcttgttcatcacccgaaagctcaggagggcctttctgtatttactatccgcgaaccggccattgcccaggaatatgggatgaaaccgctccggatcggtcataaggatctctcgatttcagaccttgggctggtatttgatctgactgcggcacagtatgaagttgtcaacctcctgatgcccttttcaacaaatgaaatcatcgattttttcatcaatgaagatgtcgaatccctcccctcacacctgcggaccacagcctacatcgggaaccatcaggatatcgcacagcgtgtcaggagtgcgccggctgatgcacttcgtcttgtccagcgtcagatccggactctcctggacctgacctcactcttcgtagattcatcgtcctcttccctcccggaaattctctctgatcttgatgaaaataaggttgtcctgattgacatcccggggatgagtgatgctgcagaacttttcatcctatctgcaatctccagggcaatatttaaggatcgtcaacgtcggtttattgaacagggctctgcagccgcaagcggcagggttctcatatccattgaagaggctcaacgtgtcctatcccagcggtctgaaaaaacaggagtttttcgagagattgccatggaagggagaaagtttggagtcggtcttggcgttatcacccagcagccgaaaaatattgatcaacgggtgctggcccagatgaacaccctctttgtcatgggacttgctgatcatcatgaccgtgagatcattgcgtcatctgcaaaacatgatctcagggttcttgacacggaaatccagactcttgaccggggagatgccgttatatcaacggtagggatacccttcccggtcagttgtcatattcattattttgaagagtatctggatgccctctgggaagcggctccctgaatcaatgtgcaatctcttttttaaatgctacccagagaagaactcctgataaaaccagaccgcccagaagatttcctattgttgccgggatgagattactgaagataaatatactccatccaagatttcccgcaagcgggccgacctgtgccacctgcaggaacgtaagatgaggtgcacataaaagcccggcaggaacaagagcagcattggtaatggaatgctcaagaccggttgatgcaagggccatggaaggaaaccatacaccggcgatctttcctattgcatcatcggcacagataccaaggagaacggcaaggttcaggagccagcccgctgcgactgctttgataaaacaggcccatatcccaataagcccaggataactgcaccgttctgaagcaaaggctaccacgtttaccgcagatgccccagcagtcattccctcaggacctggctggaggaggactccgaaggtcacaagggcggcgaaaaagagagctccgataatatttccgatataggacagaccccataatctgaatacagaaagccagctgccctgaccggaaaatgcagcaaaaggtgccagcattgcatccccggtacagagttctgcaccggtcaggacaatcaggataagcccgaggggaaatacgaagcccgaaaggagctgggctattcctgttccgagggcaggtacaacaccggtcgatacgatcatcatcagtgatgcacccatggcaatatatgccccggccatccctcccctgagcagaatattccatccctcaagtgacatccggtatttcccggactcagcaccttttgctatgatttcatacggggtatgatatgacatgttctcctcctggatattgaattttcactcttcttttgaatcaatttctttcatgtttccggtttatcaggtaataaccatatatgcgatgactgataagacaactgccaggagcagcatcccggcacttatgggaacaacatagacaagaatagtatttacaatacttgcaagttgggcaatagagtctgatccaaatatgatgactccgttgcaggttgcagagctaccggcagccttcgcttccgaacggtctttgagtgccagttcaaccccttcaagcacatgagtcacgaggtcatcgggtgaaatctgaagcccgaccgggtttttaccactgatagtattcacaacatgggtatcagtagtcatcacctcagcctcatcgacgagggcacggacctcatctctgatatattccctcactccctgtgccatgttgttcccgtcaatgagaatatacgcagcagtcatccctccggtttcagttaccaggacctgcagaccaatatctccgattccctcctctctggtgtatggcagggggagatgtgcatatcctgcctgcagagggtagagtggttcaacttcccaccggttcattgcctctgtagcagcggtgaagtattcatgtgctgttctggtccccggaagaatgacatcgatctcatcaccaagacagttatgcgcatctataaaccctatatggggtgtgatcttatgtccttcacagatgatggcgtgcccgataccaaaatcaatatcttcagtcttatccggggagcgggtactgaccatcagcagggcatctccgattcgctggtagaggagtgatactgttcccacctgtatcctgcccggctttcctgcagattcatgccagtggagtgatgccttggtttcattgactgcatcgacaattttgtcaatctcaccttcagataccaggttgtaatcatgagttgcacatccatgagcaaccatcatctcctcatcaaagcgttttctcagaattgagggaagatttcctcccccgatctctcccatcggccctggatgcacatttggaatcgtgaggattagatccttttttccttcacgtctgaagaaaatactgacctgtggtatccatgcctcctgtccgatatctctgaagaactcttccattcccttgtccccgtcggtaaggtgggcaatgaatgcatttaggaacttcaggccacgtatgtgaaatgcccggtataatggccgatcaatgagccatatcaggatggcaaatccggttccaaagaagatcatcaggacaggggtaagaacggggaagggatccggaaggatgggcaggacacagacccatccggcgatactctgaatggatgccggaatgatcatcctcgatgtccggtaatctgcaatcgagacgaggacaagaagccggactccaaagataaatcctaatgaaatggcataacacagatcaagcaggtccttaaggaagataaggccgatgagagtaatcaggcatgaaaagagtgtacaagaaaccgccagcaatgcccctctgttccaggtcatctgacggttgagcagtatgatcagaggccgtgtcagcagaaatgcaataactcccggcacgataaatcccaggataccaaaccattcataggatggatcaagtcttctggagagaatttccaaaaggagcccgagaattatcagaatgccaagtgacgccggccatcgtggtgcggtaaagatgtactttgacatcttttccattctgactgcactaccaggaacggtatccatgcctgtgtacctgtatgttatgcccgttttggaccatgagaggggaatgggccaaacttttctccataccgtctgaccatagtctgccagttaggaaggccggtctgacacccgcaggtctccacgacaaaggacgcggtaaccaccccgattctgcatgcatcttcggaagaataccctgcagcataggcagtaagaaatcctgccctgaatgcatctccagcaccagtcgggtcaacacaggggaccggtaccgcagggatgaagtgctcttttccctggtcatagagcactgctccgtctccgcttctggtctcaatagccatcgggacccgggatatcagttcgtcacggtcaattcccagggttttgcacatgccggcatattcatgatgatttgcgatgagaaggtcgattgaatccagaatggtgttcagatgatctgctgtgtaccggtgaagatcctgcccgggatcaaatgaggcaaatcctgactgttttgcaacctgtacattaaatccggggtctgcagttgccatatgcacgaaggggagtgaaggggctttttcggtctcaaagagatatgatgcaccccactcgaaataggtcatctgatccccttcagggccggtgaacataaatgcagttgccgtgtgcttttcaggagcgatgaagaaccgctggtcaataccaagttctttcattctggagtcatatgcactccctgcaaaatctccgccaactgcactgataagtgacactctccctcccaggagggcgattcccacggcaatatttgctgccccaccaccaaacgcaatcgttctctcaagtattgatgctgatgcattcggaccagggaggtgggagactttacagatatgatcaacagcagtatgaccgactacggatatcacaactcttcaacctcgataatctcaagagggatatcccggagggcttttccgatggttgataatgcaattctgcgtgcatgctcttcagaatccgccttgtatactttcatctccatttttactccgacaagggcggttcttgcaacaatcagtgtgcacggaagttcttcctcacaatatggacatgaaagaattcctgcttcaacctcaacaaatttcgcggttgggttcagtctttttcctgcctcactgatcgcaatactgatggcgtcatcgaccgaatcagcatcacggattgtccaggcagattctaatacaacgagataatcaggcattcttactccttttttctagggggttaccagtatccgtaatgaacatgttcaccggtttccatacggggaggggatggcactatttcacgggtatatccggcagtgagaagtgtgaccggccttatatgtccggggatgtccagtatctcacgaaccatctcatcatcgaatgctccggtccagcaggaaccaagcccggatgcatgaattgccatcatcaggtatgttcctgcaattgttgcgtcctgcatcgcatagagtatgccccgctcactgtacctggacatggatctgacatagttggcacagactacaaagataaccggagcagctgatacatgttcctgttggaatgctgcatcacacagaagctcccgtgttccttcatccgttaccacaataacgtcccatgactccagatttcctgcagaaggagctgagcgggtagagagaaggatctcctcgataatggtatcggcaacaggttctgggagatactgtctgaccgatgttcgtccagctaaaaaacggttgagttcagacaaattcatgtttttcaagttcctgccaggcaagcattgcaaccgttgtggcgtgggtaatagcagatccaatgctctttaccgactgatcaaaatcactgctttctaccagactgatagcatggttcagattatcgattgatttttgaaattctgaattattcgttgccctgagtgcaaactgtagttcaattcgtacagattcaaggcactgaagaacaatctttctcccaccggtgcgttctgcatccttcagaccggataacacggtaatcagttgtgatgctataattaattctgattttgcccgctcaccatactgatacgcggaaacagcacccttcttgtccatagtacgtactgaccgtacgcattataagtaatgttcatatggtgagaagagatcactttttgatatccatttttcacactgatgtggagaatttcaattcaacgaaaacccatgacatccaggacgacatgctgagcatatccatcgttggatgtttcatggccgaaaaaagagtgaaaggctatttgattatttcgagcgctgtttctggccaagcatggatactttcgggcgtcccattcttcttcgggctgccatggtgcggagtgcctgagtctgtccggctcctcctttgccaacgcgtccgccccgaacaccagctcctcctctgcttccgccacgcatctctccaccacgacctcttccaccacggcctgcagcccgttccattctcttaatggtggtctgtgccttaaaccgctggtttggccctggctttttcgtttctccttccttctttggaacaaggcgtatctgacctttgcttccctttatctgcatccattccgtggttcctgtcttgcccataattgcacctcgcgaatgcctgtactattgcccgttatcatcaattaaagattgtctaatatcggtccatcattcaggcatttttcagtacctgagagatagcctcgcggagaatctggttcacgatcttcccgtcaactgatcctcgcacttctttcatcacaacgcccattaccggaccggttgcagcattcccgcgctctttgataaaatcagcacgctctgctacaatccggtttataatttttgtaagttcttcttctgagacctttggcgcggctcgttcacatgcctctgccggcgtcttcccctctgccagggcggtcaggatgggtgacaatgcctctttggcaacctctccagagtttatgagaataaggacctgtaagatgtcctcatccttgatacggtgaacctgtgcaccctccctgctcagttcccggagtgttgagttaaatgcccgttcagcaagggcgggtttgattcctgaatgtattgcctcttcaaatgcacttctccgctccgagtatgccatctgcctcgcaacttcccgtgcaaggccgaactcctgcatgtatcgtgcgatggtatcatctatcatttcaggaatctcaagggaggcaaaccgttcaggagtgacccgtacctgaaatacatcggtctccggatacatacgggcagcacctggtaatggtctcatatatgcagtcgagccgccttccagcatcttcctggtctcttttggcaccccttcaaaagccatctctgctcttctgatgatctgctgcatggcacactgacaccgctgtggtttgtctgccacaatgataacacagtcatctggtgttgcatcaagagccttcttgagatttgttacttcatcttcggtaacaccgtatgcgggcagttcatcagtatggaagagccctccaactccgcatttctttgcgtaatcagacatctcacttccaagacgccggccaggctggatttcccggcccacaagtcctgcaaacttattcagacggatggcaagaattttcggtgctgatttcagaactctgctcttactgtcggtaaagagcgatgttacatcaaccagggtcttctctacagatgctcctcgttttttaagttcttctctgatctcaaggagtgaaacctgcctgcatacttctctcctgacgacttcagcgataagatcaagttcctgcactcctttgatctcaaccctggcaccttcacgaatggagatattaatgtcttgtctgatggtcccaagaccgcgttttacctttccggttgaacggaggatcataccgatctgtgcagccgtctcctggacagcttctggcgtatgcatgcagggactggttgtgatctcaatcaggggtatgcccagacgatcaagtgagaagatggtatcttcgatcctctgcgccgcctcttcctcaagacagacggtctcaatccctgcaccgcctggtaaagtgccattcatcgcaaccagagcagtccgctgaaaaccgctcgtgttcgatccatcaataaccagttttcgcatggtgtggatctcagggaccggcgtcatcctgcagacttttgcaatcgtgagaacgatgtcaagtgcctcttcattgagcggtgccggcggctcttcatcattctcaacaagacaggttgtatcataggtcaggtacctgaactgtctgacctgcatcatctcttcttcagcagcccggtcaagttcgcccatctcgctctttgttgcacggaggtacctgaaaaattccccctttgactcttcagcctcacggatcgtcgttggacacctgcagaagagtttctctttcgtgttcagctgctggtgaatttcaatcccggcaatcaacccgagtttctgatagtctatagtcatactgatgacctccgggttatctcaccggccagattctgcgtcatcatcaaccgtgcctcggagagactgctgctgtttccaagcacccacatgagtttgaccagggcgacttcaggaagcatatcttccccctcgatgactccggctccgagaaggtcccgaccggtatcatacacccggtcacagatccgcccgtgcagacactgggatgtcataacaaagagcgttcctgctgctgacatctcccttattcgtgcaatcatatctgtcccgcaatgtccaagtccggtccccgcaagtacaattcccttgtatccgctccatgctgaaagaagagcaggatccatccctggataataccagattatggcacatttttcttccagatggtctttcagttcaggctcaccgttccctctcttcaccgcatgggaagcgagtgacacatcgagtgacggataggtgacagaaccgattacgccatcgccaatggtctgaaatgcatcccgccttgaagtatgcatctttctgacccgtgttccccggtggatggcgcagacatcgtcactggttgttccatgcatcaccaccactacttctcccaggtctgacagggcagtttttacggcgcacataccattcatgacattatcactgctgggacggtccgccgatcgctgggagccgacaaagacaaccgggaccggggtttttatcataaaactcatggcagcggcactgtatgccatggtatcggtcccgtgagttaccagaataccctgagcacctgatctgatttcatcatatattgcacgggcaagctgctgccagatagcaggagtcatattttccgagaggatattgcagagctggactgcactgaactgggcaagagatgcaaggcccgggatagcgttcaggatgtctgttgcccggaactgactggtaacagctcccgtccggtaatctatcttacttgctatcgttccaccggtagagacgattgagacctttggaagtgttgtatcctggataatctcaacctcctgaggctctgccatttcagagctgccggttttcgtaagactttcttccggaacaccgatattatatcctgatgtgagtttgacggttgccatcccgtcccgtgttgtaatatatgtcccttcacaggaacatccctgcaaggtacatctgacaagatctccggtttcaaatgtagtactcataattgtgcaattctccgtgcctgtgtgagaagttcatgtaatgatgctgatatctgcgtctttttatcgcaaatcagttcgatatctttttcaagttctttccgacgttcagccagggcatccagcaccgcatcaggggcaggtccgccaggcagtttcctgactgagagggatgtactgactgacagggctgagtctatgttcttttgtgtgactccaagggaagagagggtttttccatagaactcctctgctccacggtcaagcgtgacaagatcaagcgatccatccttcaccgcctttccaacaatatggtgggcagttctgaatggaatattaaattccctgaccagcgtgtcggcaagttcagttgttgtcgtcccccctcttcctgcttcttctgccatccgctcccgattgaatgtcgcagattctaccatgcctgcaagaagatcgatatcccgcctgactccggttatcccgcgccagaggtgagggttcagatcctgcaggtcccggttatatgccatcggcagtcccttgacaatcgttatcgctgatacaaatgatcccagaatagttcctgtcctggaccggagtatctctgctacgtcagggtttttcttttgtggcattattgagctggttgaacagtaccggtcatcaaggttcacaaactgaacaaatgctgagctccagatgatgagttcctcacagaaccgggatatatttgtcagaagcatggtgtcacatgccagggtctcctctgcaaagtcacgtgatgcaacggcatccattgaatttaccagaatcctgtcaaacccaagcaggtctgccgtaaagggtcggtcaagcggatatccggttgatgcaagggctgcagatccgagcggggaacagttcacccggcgcaaggcatcaaacaaccggtcaaaatcccgggagaacatctgttcataggcaagcagatggtgggccagcgtaaccggctgggcatgttgcagatgcgtaaatcctggcatgaccgtagtaatatggtccgctgcaacagagagcagcactgaccggagccgtgtcagcgcttcaagctggtcaaggatgatatcccgcgttctaatccgaaggcaggttgccacttcgtcatttcgtgaccggccgatatggagccgtccccccacatcacccccggtctttctggtgaggatggtttcaatccccgcatggatatcttcatacgagggatcaaacgcctctgcgggcacaccggattcatacatgcataaaagttccttcatcagggtctttgcatggtcctcatgtacgatctgctgtctggtcagcattaccagatgtgccatatcgaccagaacatctgaagaagcgatatttctgtccgcctccatcgaggagaggagtgattcaatatcttctgtcctctccccggagagccgtgcctttctgacgacatctctggtcataatcccgtatatctttcacgggaggatcattaatgtccaccgatgtatcaggtggtggagttattgacaatccccggatctcaccgttatgaataatacaatgagggcaaaaacaaggaataaaatgggctcaataatcatttaatcgaataaaaaaggatagtttatgaacctgaaccgactagtacataagacaggtgagattatcatgaagaatgtttggcttatagcttctctcttcctcattaccggtctggtactcttatgtggatgtaccggaacccaggagacagcccctgcatcacagcaaagtgcagcaggtgaaaagactgttctgaatatcggataccagccaagtacccatcagatggcatttatgaccgcatacagcaagggtatgtacaatgagactcttgcccctcttggcataaaagaggtcaaagcatatagtttcccgactggtgctcctgaaatgcaggccatgcttgctggtgaccttgactttgcatatgttggtgctgctccctttgtcactgctgctgcaaccggccttgatggtaagatcatcgctgcggcccagacccagggttcatcagtcgtcctgaagactggtctgaattataccagccctgtagacctgaagggactgactattgcaaccttcccggctgggaccattcaggacaccattctgcggacctggctgaaagagcagggacttgacccggagaaggacgtcaagattgtagccatgggaccgggagatgcaacgacagcaatcatggcaggaaaagttgacgcggtattcctaccggcaccttccccgacaaccattgaggaggccggagcaggaaagatcatcattcattcaggtgagatgtcaccaaaccatgtctgttgtgttcttgttgcaagcggaaagatgatcaaagaacatccggagatcgtcgccgaggttctgaggattcatcagcaggcaactgaatataacaagcagaactgggaagaagcctctggatatatggaagagatgacggccatgaacacctcagtgattatgaaatcgctaaatgagtgggatggcgagtgggtatctgatccacatatcatcgtcgagtctgtgaccagttatgcacaggatcaggctgcacttgggtacattaagactccgctgaacgctgatgatctgattgataccagcttctgggataagcagtaacgcttcaccccatactttttccttttctcaaagaccattactactggagcaacgtgtcagcatgctggcaccatagtgagaattaagcaatgacaggaattctaccgggatcacgatcccccggctacacaattctctcaatatcagcactcctgatattctggcaggtgcttgcagatgagattgtgagaaatcactttattctgccatcctttaccgatgttatcatcgccttttatgaacttctctttgtcggaacattacctatggactttgccgtgagtatgatccatttctttatcggacttggattctctctccttgtcggcgtccctgccggcatcctcatcggatggtacccggtcgtcaaccggctgcttgatcccatcattgagatcatccgccctatccctccccttgcgtggattccttttgccatcgtctggtttgggcttaccgaccttgcagcaggttttgttatcttcatcggagccgtctttccggttctcattaacacatacgagggatttcgcaatatcccacggatttttgtcgaagccgggaagatgcttggatgtacgagtaatgccgctcttatccgttttatcgccattcccgcagcgttgcctcatcttgcggccggtttccgggtagcaagcggggttgcgtggatgtgccttgtggcggcggagatgtttggggtatccaggtttggtctgggccagaagatctggtggtactataatctgcatcagatggacaaggtcatggtctatatgctgattctgggttttatcggacttcttattgattacatcttcagatatgggatgaaccggactctgctcaaatggcgccagggagaggtgaactgatatgggcagagtggaaatatctcatatcagtcgggaatttatcaaggaggatggggatcgggttgttgccctttcagatattaatctctccatcgccgatgatgaatttgtctcatttgtcggtccctcagggtgtgggaagaccacgctgctccggattatcgccggtcttgataaggccagttccggagaagtccgggttgatggatcactcatcaccggaccgggtcagaaagtcgggatggtgtttcaggagtactccctgtttccctggcgaagtgttctctccaatgttgccttcggacttcagatgagagggattccaaaagaggaacggcaagagattgcacgaaaatacatctcactcgtcggcctctctcagtttgaacaaagttttccgtatgagttgtccggtggaatgagacaacgggttgcaatagcccgggcacttgccacagatccagatcttctgctcatggatgaaccattcggcgctcttgatgcccaaaccaggaatcatatgcagtgtgaactgctggatatctgggagacaaaaaagaagactattttatttgttacacatagttgtgatgaggccgtgttcctctctgaccgtgtggtggttctctctccacggcctggtgttatcagagagattatcaatataccgatatcacggccacgtgacaggacaaacaaggagtttatcgatctcaggcgttgtcttctcgagatgatcgatgaagaggaacgagaggaagaaaggattaagtgtaaatccggcaatttataaaagcacatatcaatacaggagttcgggttcatggtcagaaaaccaaacagcatgtacagaaaccttgcgaagaaggcctatactcgcaaggaatatatgggaggtatcccaggtgttaaagtcgttcactttgatatggggaacctgacaagcgaatttccaatggaagtttccctggttgtggatgagagctgccagatccggcactccgctcttgaagcagcccgtatgagcattaacaggaagttgaacaaggaactggggcgtatgaactaccacctcaaactgcggacctatccacatcatgtcctgcgtgagaacaagcaggcaaccggagcaggtgctgaccgtgtgtcacagggtatgcgccttgcatttgggaaggcagtcggaactgcggcccgttgccagcagaatcagaagatctttacggtcttttcaaatcctgcaagtgttgaaaagatcaaggatgccctccgtcacggtggtcataagcttccttcccccacccatctcgttattgagatgaaacaggaatcataatttttcctgaaatctttttttattttattggatcatttctatacctcctttcagacagatatatcaggtatgtctgaatccggttatcctgatcttctgaaacggatctctgatgctacagagaaagcagtccgtaatgcagaaatatatcttccagatgatgtgaaggccagattgacagaggccctgaaggtggagtctgttgttgtcgcgaagcaggaacttcagaatattcttgaaaatatctgtcttgcagaagaacgttttgcaccactttgtcaggataccggcattccggtaatgtatatcaccgttccttatggcatgacatggacccctgaaatggaacaggcagtcctgaccggaattcaaaacgccacacagcacattccgcttcgtccaaatcttgttgaccccgtgagccgtgaaaataccaaaacaaataccggtctttccatgccccctgtccatgtgaaacacggtgaccggtttaccatcaccgccctccccaaaggtgcaggatctgagaatgtatccagaatcaggatgatgaacccgtcagataagggaaatattccaaaatttgttgttgagaccatgctggaagctggagggcggccctgtcccccggtcattctgggtgttggaatcgggggaacctttgatgtcgctgcatccctggcaaaagaggcattgctggaaccggtggattcgatgaccggctatgaacaggagatctgtgatcaggttaatcagcttgggattggtccgatggggcttgggggtgacaccacctgccttgccgtaaaaatcaaaactgccgggtgtcacacggcttcccttccggtagcggtcaatatccagtgctgggctgcacggcgggcaaccgtggaggttcccctatgaaacaactccagactccgctgggtgatgaggtcctctcgcttaaggccggagagatggttaccctctcaggaactgtctacaccgcacgggatgaggcccatctgaagatcatggaggatggatttccttttgatccgaaaggggctgtgctctatcactgtgggccggttattgccgataaccggatcatcgtcgcaggtccgacgacctcggcccggatgaaccgcctgaccggatatatgctggatgccggaatcagagggatcattgggaaaggggggatgtcagcagaggtcagggagctcctgagaggcagggcagtatattttgcctttaccggagggtgtgcaaatcttgccgcagcccggatgaaatgcaccggtgttcatttccctgaacttggaatggcagaagcggtctgggtaattgaacttgacaagctcccgcttaccgttgcgatggatgcacatggcggagatctctttgccgtgatcgaagatcatgcacatgaagtatttcaggctatgtatccaaccagtacgaccagaatatgaaacttgagattgacgaatcccggtgcaaaggctgcaacctgtgtaccatggtctgcccgtataaaatttacaggccggggagtcgtccaaaccgcagggggatttatgttcctgacctcgatcagccggaacgctgcccgaactgccggctccagggattgtacggacgacggttatgcggtgtgtgtgcattaatctgtccggatcaggcaatccggtgggtgcctgaaaagccctttgaaccaatgaaagtggtgattgagtattagccggattgcttttatgcagggaaatattgcaagtgcagaaggggcgcttgcagcaggatgtaccttctttggagggtatccgattactccctcaactgaagtggctgaacatatggccgcccgtatgccaaagatcaaaggggcgtgttttatccagatggaggatgagatagcctctatggctgctattatcggggcagcctggaccggtgccagatccatgaccgcaacatccgggcccggcttttccctgatgatggagaatatcgggtatgcagttatgaccgagactccctgtgtcattgtgaatattcagcgtgggggtccctcaaccggacagcctactatggcagcacagggtgacatgatgcaggtgaagttcggatctcacggagactacagtattatcgcccttgctccgtcaagtgttcaggaatgctttgacctgaccgcaaaagctttcaatctggctgaccgtttcaggactcctgttttcctcatggctgacgaggttatcggacatatgcgtgagaagatcgagatacctgacagtgtggagattgtgcggccaaaaacccttgcagaaggtgctcttccctttgctcccggtccggacggggttcctggatttgccgcctttggaaccggacggcacatcccggttactggtctgactcatgatgaacgtggctatccggatactacaaaccctgcacgacacgaatccctggtcaggagacttatctcaaagattgaagatgcacgacatgacattgcagattatgcaatcgtgaatgaggaagcagagtatgtttttgtctgctatggggcaccggtcagaaccgtcagggaagtagttgagcgtttcaggattcctgataccggttatctgcagcttcgtatagtatggccgtttccagaggatcttctcagccggtttccgaaggtaaaggcctttatcgttcctgaaatgaaccttggcatgatggcaagagagatagaacgtcatgtcagcgttccggtcatcccggtcagcaaaatcggaggagatctccatactcctgaagaactggttgaagcagtgagggttgcaggtggtcttttatgagagatgactggttcagagaggatcgtctcccccatatctactgtgccgggtgtggaaatggaaccatcatgaactgtgtcctcgaagccgttgaaagaaccggatgggatcagaaaaagacaatatttgtatcaggaatcgggtgttcttcccgtgctccggggtatatcctgaccgattcactgcataccactcatggccgtgcaatagcatttgcgaccggtgtgaagatggcaaatccctccctgcatgtggtggtatttaccggggatggagatctcgcagctatcgggggaaatcatttcattcatgcctgccggagaaatatcgatatcaccgttgtctgtatgaataatcatatctatggaatgactggaggacagggaagtcctacaacacccatcggaaagacctctaccacaactccgtatggtgcagatgaagctccgtttgatctcgcagaactcgccattgcggctggtgctaattatgtcgcacggtggacatcatttcacgtgaaacaactgacggaatctgtgcttaccggtctaaatactccgggattttctcttatagaagttcgctgtcagtgtccgacatcgtacgggaggcgcaataaatatcgtgagcctgtagattacatgacatacctgaagtcacatgcagtcctgaaagagaaatgggagagaaccgccgcacctggagctgaacttcccgctgattcattcctggttggggagtttgtgagaagacaaaggccggtaatgggggtgccagatgaggcatgaaatccggttctccgggtttggaggacaaggcatcatcctttcggctgtcattcttggacgggctgctgctctctatgatcagaaatatgcggtccagacccaggtatacgggcctgaggcccggggaggagcatcgatgagtgcggtgatcatcgatgatgaaccgattctcttcccaaaggtcagggatccggatacttatgttatcatgagccagcagggatttgaaaaatatggaaaaaacccccgtgctgatgcagtcatgcttctggattcagatctggtgcatgaccggccttcatgcacatgggttggtatacctgctaccctgtctgcaaagaaagaccttggccgggagattgttgcaaatattatcatgcttggtgcattaaccaccgctacgacggttgtttccggtcctgctcttgagaaggccatccttgacagcgttccgaaagggacagaggatctgaatctgaaggcgatgagacgtggacaggagttgggcatcgagggtggatcatcatgaaactaaaggaatatgaagcaaaggatatcctgcaaaaagcaggcataccaattccccgtggtgtattagtaaagaagggttcggattatctggttagtccggatattaaagaggcagcgatcaaggcacaagtggaagtagcgggacggggcaaggccggcggcattctcatggcagatcatgcaggtatcagggatacgactgaaaaactctttcaaaccaccataaaaggcctccctgttgaagagatcctcatcgaagagaaacttcagatccaacatgagtattatctctcgatcaccatcgatcgctctcaaaaagcgcctgtcattctcttcacaaccgaggggggagtggatattgaagaagttgcacaaaaaaatcctgccgcaatacgaaaagcaaccgtatatcccctcctctccaaagttcccggatacaccctccgataccttctgaatggtgccccaaaggagattggagccattattcagaaattatatactgtttttatgtcacaggacgcattgcttgcagagatcaatccgttggtcatgactcctgatggtctgtttgccgcagatgcaaagctgattcttgacgataatgccctggcccgtcatggcattcaggagaaccgggatctctcggaacgtgaacgtaaggctgctgctcatggattctcgttcgtggaactgaatggcaatatcggtgttatcggcaacggggccgggcttaccatggcaaccgtggatctcatcaaccggatgggtggcagacctgcgaacttcctggatgttggtggaggagcagaccgggtcagagttgcgcatgccgtccgtctgcttgggtccatgccggatgtgacagtcattattgtaaacctacttggtgggattacccggtgtgatgaagtggcagcaggtattattgaggcaggtgtcagtcagcagatcattgtcaggctggcggggacaaatgaggcggaaggaaaagccctcctctcatcaaaaggatatctgatgcttgacacgatggaagaagcggtgactgccgcggtggaggcagcatcatgatctatgcagataaaaaaaccggcgttatcgtctgcggtgccaccgggaaccagggctcgtttcatattgaccggatgaaccagtacgcccgttcaattggcggaagaggtgtggttgcaggggttactccgggaaaaggcgggcaggaagtgcatggggtaccggtatacaactccatcctcgaagcagccgaggcacagaatgcaaccgccgcggtattatttgttcccggttctgctgcaggggattcgatcatggaggcggcggatgccgggctggatcttgtggtaaccatcaccgagcatattccggttcatgatgtgatgcatgcggtcacctatgcgcaaatgagggattgtacggtcatcggtccgaactgtccaggtctcttctcccctggcgagatcagcatgggtatcatgcctgctcatctggcaaccaggggtccggtcggcgttatctcacggagcgggaccctgacatatgaggtggttcatgagctgaccagagcaggtatcggtcagagttcgatcatcggcattggtggggatcccatcatcggacagaccttcgctgatgttcttgaaaggtttgcagaagatccgctgacaaaagcggtcgtcatccttggggaacttggtggtaaccttgaggaggaaggtgcacggtctgcagaactacctgttgttgcttttattgcgggaacaacggccccggctgagaagagaatgggtcatgccggagctatagtcaccggaggtgagggtgatgcaaatgccaagattgcacgacttcgggatctcggtgtcccggttgcagatcggctgtcagaaattcccgcaatgattcggggggcaatctgaatgtccatcattgaaaacctccgccgcggtgatggagaagaggcagggggcgggaaatttaatccgttccgcattcttgagatcggagagagcatggtccggtattgtgatggcatcaggatcaagaattacaatttccttgctattctgaccagtgaccgacttgttctgattgaaagtgcccagcagagtgcaggaaccattgcaaaggagatacctgtctccatgattcagggtgctgcgatggagcgggatgagaagaaccggccatccctggcggtatcaatggaggtcggaggtcagacccgtctgatgaaactggtgtttaccggacttattgctgaaccagagaccgaatgccgtgaatggtttgctgccattaatggatatccccctgaaccggaacttaatcaggaacctgagctcctggttgctccagaaccgacaccagaaccaacaccggtctctctctccccgcccggtactgcagggcctctaccggttcctgcacccgctccagtgccctctccgataattgatgcagaagcagtctctcctgtaccaaaaactgaggagattcaggagcagattcctgcaccggtacaactggaacctgcaccaacacccatcatccactatcaacaggaacccgtttctcccccggcgcctgtggaaatctcccctgaagtgccagcggtcatttcaccagcaccgaaagctccggttgttgataaggctccggagtccattccacaaaaaaccatgcccattccaaaaaatgggaaacaacgtatatcagttccggcacctgacacggaatcaatacaaatttcattagaaaaacccaatatcagcccgctccggtttaaaagaagggacacaactcctgttagcggaagcagtgggaaagccaggtactgtatacactgtggttcacggtttcctgctttggcaaagttttgtccggtttgtggaaagactcaggtctgatccttcatgggatcataccatggcagatatccgcagctggatgcctgtcgtggtattgccgtcctcatgatgatctggttccatttttttgtagatcttgcatttcttggattgcccgggcctgatcccttttcaggtctccttcgtatcttcgggatgctgaccacgatctcgtttattggtattgcaggaatttcggcacacctgaaagctgaaaaaactccggggatgatgaatcagttctctacgtttttcaaacgggggggcgaacttctcctgattggcatgggtattaccatcgtcacctggtgggtgatggatggcgagggttatgtggtatttggaatcctgcacctcatcggtacagcacttattctgaccccgctcctctaccggttaaattataccgggctaatccttgcagccgctctcatcctgatcgcatacacaaacctcctcccttccgggcccttatggcttgcatggtctggtatctgcccggatgatttttattcggtagattatgcaccactcataccgtggctatcagtatttcttattggattatctgccggccggttcctctttccatatggcaatccacgatgtgatcttggcgcccccggcagtttcgtactctctctggctcatctgggaaggcactcccttctgatatatcttattcatcagccggttctgttcctgctgattattagtgttgcaaaaataagtatcggatgaattatttcagaatattcaaaaggccggaaaaaagttctgaagaggtattttcagtagtattatccgattctttctcatgatccccaatcgatgaagtgatgtttttcttcaccgtctccagacgggactgcacaacggtgaggtttggatcaatgctgatcgctttttcaaatgcatcaatggcctgtgtattctgtccgatcttttcatatatcgtcccgatgtaataccatccgacggcattattctgatcataggttgttgcattgaggtatgctgcaatagcctcctcgaatttcccctggtcaaagtatgaggctcccatattttcccatgcactggaataattcggacgaatactcaatgcctgccggtatgagtctacctcctcttcataccgtgctagtttcccaagcgtgaccccccggttataccatgcatcagcatcctgtggagtaactctgactgcttcatctgcaacttcgagggcctcttcatattttccctgcctgttcaggacgatccccaggttattgagtgcatcggaaaaccccggacgcatcttcagagcgagccggtattcatttgtggcattttcatactggccaaaggaggacaatgcatttcccataagataatgctcatctgctgtcatttcatccgtttctgcaaaagttgtggggacaaggatgagaattataaaaaaagtgatgagaggaactaatctgttcattcagtacacggttggaatagaatgaaataatgtttgtggctatgccgtacatgccctttttgctatctgaaaaaattaactcctcttcctattcgacggatgcagaacctatgtgtgagatgagggagatcgtaccgaattttatccccgtattttttcagtcctctattcttttcatgaagaaattcaggcaattagtggtctcctttctagaaaaaaatctcaatctaaaagttcaaaaaatgtatttatacttctggttgcaatcattacatcattatgccagtcaaccaggcgcaggtcgacagcatcatttcttcggcatctgccgaagatccggagattcaactgcttaagctcagggatgaggttgagctgctgaagacctcgataaaacgcctgctcatcgatatacgggaacgtatgaatgatgcggagaatccgcttgttcaggcgttaaagggaaacccggtggagtttgtgggccagcataccacagctcccactcccatggagggttatatcgatgattatgatgaggaaccatcaggtgggggtttttcagaggaaggggggacgatgtcagtgtcagaagaaccagaagcgattgaaccggtcggacaaccggatatgggaatgactgcaggtcttggtgggggagcgggcagcgtctcatcagccttgtcttctcttgcagcggagaaagggatgcttgaagcgctcaggaaccaattgtttgcccaacctgtaccgcctgcagaacctgtaaaacagaaaaagccacgtgagaaggtgaagatacagaaagtatacagcctgtttgaatggacgaccaataatgtgaaacgatacgggcatgaccgggttgaccttatgcttgaatcgtacaaggagatgggtcatatctctgaagagcattgtaaacaggtgaaagatattgcccgccttatggcaccgtccatcggggaagtccatgagatgaaggcagatgaatttgttctggcactctatgaactcaaccggatattgcaacctgatgatccgggtcttgaccgtgacatgcttgatgtcctgattgagaagagaaagatggcaatgccatcaggccggattgaggagacaaacctgatagaggatgactcagagtttgagtatataccctctcgtgagtaactgccgatatggcaagcgaagctatctcatcgtcaattatgataataggggcggtccttggggccgcagtccttattaccgcaatccttccagctattttttcggctggtgataccttcgggaccgtttcgtcgtcggctgagcagaaacttaaaacggattttcggatagtgaatacttatgcgaatgcttctgcagttcaagtttggatgaaaaatgttggaaataatcggatttccgtctatgatgtccgaaatgcagatgtatttttagggttgtcttcatctaattataaaagatatggttatggatctggtactgatgggaattcctttattgatagtgggacatccattggagaatattgggagatcggagaaacattagaaatttcaatattggggattagccctgcatcggggattgatttttctttctcctttgcgttgccaaatagtattcgaagaaccacgacatttacgagaagttaattattatatggcatcgtcacttattgctggagccgtaagtcttttattaataattattgctggatatgtcatagcatcagggattctcatggtggcagaaacgacaacattggctcaaattgatgtaactgcggcaaaggagcaaattttacagagtaatattcagattatgggtaattattcaggttcgaattggctaataattgatgtaaaaaatatcggaaatactgtatttagtggaactgatattcaaaaaatggatttatttatttatgatgggtcatcttttttaggaaaatatgtaaaagggtcgggctctgatagattttcatattcaattgagaatgatgtggtaaataaaaacatgtgggatccaagtgaaatcatcaatattaatattaatttgactaatgatcctgcgattacacctgcatgggtaaaatttgtcacctccaatggtgttagctcatcaactaatattattatctgatttctctaaaattaacctataactagattatcaaattaaaattaagagaacacctattagcaaatagaagaattatacataaggggcagtcaacatatggcagaattagatcttaccggaggcatggatgaagcccggggagacatagcagatctcctcgggaaagaggaacgaaaaatcctcacgactggaaacgctgaaatcgacaaaaaaatcgccgatggtctccctctcgggtcccttaccctgatcgaaggagagaacgataccggcaaatcagtccttacccagcagtttatctggggaagtatgcacaataacctccgcgtcgatctcttctcgacagaacttaccacaaagagttttctgacccagatggaatcgatgtcccttgatatctctgacttctttgcgtggggatatatccgcctctttcactgccatctggtagagttcaaatggactccggatgccatgaacgatatccttgaacgaatcatcacccatgtcaagttcagtaataccgatgtggcaatcattgattcacttactatatttactgagtatacaacgaatgaagcggtactgacgtttctgacccaggcaaaaaacatctgtgaccagggaaaaacaattcttatcaccatgcacagttatgcattcactgatgaagtcctgacccgtgtcagatcaatctgtgatgctcatcttctcctcatgagaaaactcatgggtgataagtacgttatggttcttgaagtggtgaaggtcagaggtgccaggaagactactggtaaccttgtcagctttgaagtccatcccggatatgggatgaagattattccggtatcagttgcaaaagtctgaatatgtcccggctgcagattcaggggaaaataccttttcaggaggctgagagtcatgatactgaagagtgtatactaaaccctgagtcctgcgccctgtaccggatgctgcccgcaaatgccaaagagtatgcccggaactatccccaccttcttgaatacctccatatcttcccggtagatgaattcggaatcccgttattcttttctgagctgaaacgtgatttgaaagggattaaggatccgaatctcatttatcctgcaaaacctccaattttcattcatatcttctttgatccgaatgatgtcaggaacttttacatccccatcgaaccatcgttcatgcataatatcggccggttgcttccggcaatcgagtaccggctggtagacctgcttgatgccctggaagaagacccggttactccggaagagcggacagcggtattaaaacgcctgctcagacaggtcatgtatatcaagaaagcaggagaagcaattgatcccagcctgctgaagattgaagggccgaaaggatttggagacaagttaaaatcattccttaccactgatctgaccgccaaagaagaaccgggtgccgagcggctttttgcagatgtgccccatctctctgacgggcgtatcatagtgagtccccaggagtttgaagcgattgagtaccagatgatccgtgacaaaatcgatgtcggacttctgtatccgtttatctcggataattttattgaggatatcacctgtgacgggcttggccccatatttatcgaacacaagatcttcaaagggctcaaatctgtcgtcggttttgatcaggaggctgcacttgatgatttctgtattaagcttgcagaaaaatcgcgtcgcccgattacgtaccggaatccaatcgttgatgcgacccttccggacggatcacgtatcaatatcgtctattcaacggagatcagccggcaggggagtaactttaccattcgtaaagcgatggatgatgtcatctccatcaccaagctggtcgaatttggaacctgtagttatgcacttgcggcatatctctggatctgcattgagaacggaatgtcccttttcatgtccggcgagacggcatccggcaagacaacctcaatgaatgctcttacaaccttcatctcccctgagtcaaagatcgtcagtatcgaggacactccggaacttatcatccctcataaaaactggacccgtgaagtatccaaaggaaaaggaaaaggtgaaggtgaaggttcagatgttaccatgttcgatctccttcgtgctgcacttcgtcagcgtccaaacatgatcatggtcggagagatccgtggagtggaaggagcagtcgcattcggtgccatgcagaccggccacccggtgatgagtacattccacgcagcaacggtggagaaactgattcagcgtcttaccggtgaccccattcttatccccaagaccttcattgataacctcaacctggtggtcattcaaagtgcagtccggcggcctgatggagcgatggtcagacgtcagctgaatgtttctgaactggtcggatatgatgcacaaagtggaggtttctcctttgttgaggtctttacctgggacccggtcactgatacgcacgaatttaccggtaaaggttcaagctatcttctggaaaacaagatcgcaaccatgcttggtattcctgagcataaaaaggcgcaaatgtacatggaagtagaaaaacgtgctaagatcctggaacggcttcataaagcaggatatactgactttatcgaactctttctgatgataacaaaattgaaaaaacagggacttctcaatatcgatatctgatccatggcatttgagggttttttagataaactgcgtgcgtccaaccagggaaaattaccctttgaggatttgtatgcgacgatttatgcaaaactctacaaatttttcatagaagacaagtacatgggttcagatcttctgttcatgctgacgtacatggcagcgatcatcagtgccgatgcgtcacgtcctgaaatttttgcatataccggagcacgatctgaatatgtctctacaaaatatatccgccgcgctgatctcctggtgaaacgatgggggtacagttatgttgaagcgctctccaatgtcgcgaagaagatagagaatgagatgctcttctccatggtgaaccggtatgcaaatgcaattgagtcaggtgttcctgacagcgattatctgaaacgtgaacttgaaactatcagaaatatctacaaatcgagttatgaacagggcattgagatgctcaaaaaatggggtgatgcatatatttcgatgctcttctcaggtgcccttgtcgggattatcatcatggtctccattgccatttacgcacctgataatatccagggcaccttgatgacctcttatgtcctcatcggtggaatttccatattgggcattgtaaccatgtataaagcggttccggccgatcctaagacacaccgactcttgcagggatcgccggaacaaaacatgattcaccggatggaaaagaaggtggttcccatcctctgtatcatcgtcattctgcttctgctcctgggtatgaatttcggtcttgtcctgatgcttatcgggatgctgctctttcctcttggggtgattgcgttcatcgatgacgggaatatcacgcttcgtgactcggagttccctacgtttatcaaaggtgtaggcgcggtacagggaggaaaagggaccactattgccccggctattcaggatattgataaaaaatcacttccttatctcgagcccctgatcaattctgtcttttcaaaattaaacctgggactggatgaggaccggacctggcagcgatttatcaacgatggcgggagctatctgatatacaagtatctgaatatttaccgggatgcgctcaagcttggtggtaaggctgacacggttggtcagatcgtcagttcatccatgcttgatcaggttctgctgcgggatcaccggcatactatttccatgggttttatgactcttcttgttccaatgcatgccatgatggttgccattttcctgtttctgtatcatattctggttgtaatggctgatgcaatatccgaaaaaatggcatcgcttggggaagcaggtgcggcattaacatccgggcagggtgcatcaattgccggagcaatgggtggaagtatgtttgtcttttccaattttgataaggatgctatcggtttttatgtcatcatcatcattaccatgctcacgatctcgaatgtggtggccgggaagattgtttcgggcggggataatgcattagtatatttttattcaagtcttatctgttctgtatccgggcttctttacatagtggctccaatcataaccggaatattctttatgattcccgtctttgaaggtgtataagcgatggttgaactctcagactctacccggcggctggtcatatttgtagcaatagtccttgggggttcagttcttcttatcttcgatattcccgtcctgtatctgatgatgggcgtcattggcatagccatcgttctgctggtcattaccggcactatcatcctgtcagaattaattcaggatttgcggtactggctgaaaagcaggcccaaaaaacctaaaaaagagaagcagccaaaagagaaaggaaaagagaaggcgaaaggcgaaggaatcttttcatcactctccggtaagataaagataccatctatcgctctccctgcaataaagctccccgcacggtctgaaaagtcccgtgatgagaagaaaaaggccaaggaagagaagaaagggagagaaaagaaggaaaagtctcaaatgcctgaaaaaacggcagataaagaagaggagatcgaagaagcgggcgtggcatctgatagtgtaaaatcagatgatactacatttgatgccgaccttctggaaggtctggatcttgatgacagtcttgacatcgatgctgaacttgactcagtaaatccggagtttgacaatatccggactccttatggagaaggggaggtcatgcctgagatcccctccgattctgacgtgaaaaagatggatatctcaacccaggatgaggaagaggagattatcctggatgatgaccagggtcctgacgagatcgacgctatctactcaagtaccatagacataggctctgactccggcggtgatgtgatctccaatcttgaagggggagatacgatcagttcttctgatctttctacctacagttcatctgaagatactccctatatgtatggtcaggaggatgacgactccggcggggaagaacagtttgaactcagtcagatgaagggtgggggcgatgatgatcttatcgcttcactgaaggctgatatcgaagacctgaagaagaaggatgatgatgtacttctgcgggatttgaaggatgttcatgtgactgctgaggaacttgctgaagagcttcaggagatcatgactatcatcaaccgaagaataaaaagaagataaataccacgaaaagatatctgaaaggagactatggcagaggttccggcaaaactggaaaaaggcgggtcatgggtgacctcacgaatcgatatcggaaatgacggtatcgttctcaaagatccatggaatgtcacagtcagctaccggagtattgttgatcttcagaaacgcggacagatgatcacgctcctcgtcacgatgccggacaagaccgagcgcccgtacaagatcgcatcggttgaaaaagtccttacgattcttaccaagaagatcatcatggcctgtaatgcatacaggatcatggcccatttcatgtcaccggctatcagaggtggcgttctcgtaactgatgcgaaatgggagaagggggctattgcagttttaaagaccggcatctggtttgtaagtcaggataagcagattagcgtgccgttaaaagaggtcgcaagtcttgagctgacaaaacgggaattacaaaagaagaaacttgatgtgattaagatcgaccaccttgagggtggcgaagttgtcaccagtttcatcctctgtccgctctcaactctgcaggttttatacaatttccttcgtgatgcaaccaaggatatggacatgaaagggtctgagctggatcagcttgatgcccagactgcccaggtcgccatgcttatctacagcggaatggatacgaaatcgattgaaaacatgctcagccttccgcctgaagaactgaatgcaatatacgagactcttttaaagttaaaactcgtggatgttgtaatggtcagaaaggaagtgcaactgactccgaagggtgtcagatacatcaccgacgcactcaagccaccttcgtaagaccagatattccacaatccttttaccaattaatatcgtttaattcataggaggaaccgttcacccatgggacgaatcctgattgtcgatgatacattgtttatgcggaccttgctcaagaacatactcagctccgggggacacgagatcgtcggggaagctgaagatggtgatatcggcgttaccaaataccgagaattgaaacctgaccttgttacgatggatgtggtcatgccaaagatgaatggcattgaggcattaaaagccatcaaagcacttgacgccaatgcaaaagtgatcatgtgcacggcggttggtcaggaacagatggtgaaacttgcaattaaaagcggagcgagaggttatattgtaaagccgttccaggctccaaaggttctggaagaaattggaaatgtccttggtgcttaacacatgatcagggttctcgtcatcgacgattcactctttatcaggactgtagtacaggacatgctttccgatgatccggatattcagattgttggtgtcgcatctgatggtcttgaagcgctggataagatcagggaactgaaaccagatcttatcaccctggacatagagatgccgaggcttgacggattgtcaatgcttgagaggaaaaaggagattgacaggtttcctaaaaccttggttttaagctctttgacttctgaaggggcagagatgacaaagcgggctattgctcttggtgctgatgactttatgctgaaaccaagaggaattaagaatatccgtgagattggtggagagttaaagcataaaataaaaaatatctgtacgatcgcctacattacggcaaaacctgtactaaaggatagtaatgccaggaatgttgtgcttatcggttcatcagccggaggaccaccgatgcttgatacaatcgtgtcaaaactaccctcagatctgaatgcagcggtgattatcactcagcacatgcccaaaggcggatttactgcagcacttgcggcgcgtctgaacagaatctcaccattgcagattcgggaaacggagaacggggatgttttaaaaaacggtaccgttctcgtctccagagcaggatttcataccattatttcgtctgtccttgacaaaggtggcagtcagagtggcaaaattatcctgacagactctccaccggttcataatgtaaaacccgcggtagataagacgttcatctctgcagcgcaggtgtttggcaatcactgtgtcaccgcaattttatccgggatgggaaatgatggtggcgaaggtaccgaggcgataaaaaaggcaggcggagtcacgatagtatgcagggaagaggactgtcttgtctacgggatggcgcgttcagcattatcccggaactgtgtggatcatgtgctctctttgcaggcaattcctgaaaagatcgttgaaactatcagggcaatgaacgggtgaattatgtctgatctggatgcataccggagtctctatgttgcagaatcgcgggaaaaccttgagggtattgtcagcaatcttctagttctggaaaagggtacagattctcatgcgatagatgagatcttccggtctgctcattcactcaagggcatgtctgcatccatgggattttcacacatggaagagatctgtcatgctcttgaggatgtcttctcacagatcaggagtggccgacttgaggtaacccagtcactggttgatgatctcctcggtggtgcagatgatatcgaactgatgattgatgagatcgaggctggtggtgatggacagctggatcataaggaccagcgggtaaaaagtctgaaacgctggctgtcagcggatgaagagaaggaggtggtaaaacctgcaccaaagacccctgcacctatagaacctccctcatctgatacagctggtgatatgtatgaaggtcctgcatatgatcaggattacgggtcaggttgtctgacatacacaataacgttctcacttgctgacaatgtagataacaaaaaccttcgtgggatgctgatacttcagaatctggaaagtatcggcgagattgttacctgttctcctgaacggactatcgttgaggatgatgagaatttcaccgggaacgtcaccctggaatttcggacaaatgccggaaagagtgcaatagaaaccattctcggtgtatcggatattaaaacccggacgatctctgagcctgccatacccgctgaagtatctggtgttccccaggcgaaagatgaacctgccattcctctaacaaagggtccttcagacaccggtttcaggtatgaaatccacgtggagatttcgtcttcggttgattcacgtaatcttcgttcaatgctgctccttcagaaccttgaggggctcggaaccattttacatctctctccaaagcgtgagatcatcgaggatagcgatacatacaacggggttatggatattctcctcagtacagtcgagccacaggagaagatccatgccctgctcaagggttcagatatcaaaaattattctgtcagggtagaagtacccgagatttcaaaagaacccggcgctgccttggagggttcagatagtacctcttttgccggaatccgagcatcatcagcagataaggcagagaaaaaacgggaagttaaaaatatccgggttgatattgaccggcttgaccatatgatgaacctggttgaggatctggtcatcaatcgtggccgccttgagcagatcgcccagcaatataagattaaagaactcgatgaaaccctcaacatggtcggcagatcggtatctgatctgcaggtcatgatgatggacatccggatgattccgctgaatcatatctttaaccggtttccacgaacggtccgtgacattgctgccaaagaaggaaaagaagttgacttcgtggtcgagggtggtgacacggaacttgaccggtcggttatggacggtctgaatgatccgcttttacatcttatcagaaacgctcttgatcacggcattgaaccaccggatgtcaggatagcaaacgggaaaaacccgaaaggcaggctgaccctctccgcatccagggacaaggataatgtcattattgtcattgaagatgacggtggcggtgtcaacgttgagaagattaaaaagaaggctattgaacggggtcttatcaccgaagagattgcagcatcaatgagtgatcaggatgcatatgatctcctcttccagcccgggttttcaacggcagataagatcactgatatcagcggccggggggtaggcctcgatgtcgtgaagaccacaattgcctcattacagggcacaataaaacttgagtctgttcctggtcaggggagcagatttgagctggtcctgcctccgacgatggcaattgtgatggtaatgatgatccggatcaatgggaagcggtgtgccatcccgattaccaacgttgctgaggttgcaagccttgctgcattccctatccagaacatcggcaatggagaaggtctgctgatgcgggatgagatcattgttctttaccggcttgatgatatgttaggccgatccaagtcagaagaggtcatcgtcgttcttcagaatgggaaccggaagggtgccatcatcgcagatctcattgaagggcagcaggaggtggttataaaaccactttcgaagtttgtcggagcatgtgagggtgtcagtggtgttacgattccaggtgacggggaagtagtgccggttcttgatgtgaaggcaattcttcgggaaggaggacagaaatccggacgaaaatcaggcggaaggagggtgaaaaagatgataaaaaatgtgatagcagacggagatctggctattagtgaacaacaggccgatgaactgagggaacttggaaatattggcgcagctcatgctgcaacaaccctgtctacaattctgagtacgatgatacagatccgggtgcctgagatcatcctggtcaatcttgcgaatctgcgcaattatcttgatgatgtcatggccgccatgacggtctttcagatacagggccagatcaaaggtgaagggtatcttatactgcacattcctgaggattcgatcatcaggcttaccaatatcatgattgggacgactgagctgaaccgggagattgatgacatggaccggagtgccatcaatgagatcgggaatattatgacctcatcgttccttgatgcatgtgccactttgctgaatatcatcatgatcccctcccctccctctatggtcattgatatgcctcatgctgcgcttgaatccattattgctacccaagagattaaggagaatgttgatgaagtggtgttgttcaggactgaactgacctgtgcaacccatgagattaaagcaaatataatcctccttccaagcagatccctgcttgcagaaatttttgccagaatggagaatgtcatagcggtagcaaaatcaggctgaattgaatgagcgagacaattaccggcagtgaccagcgtgaggtcatcatcatcggtattggtgaatggagtacaggggatactgtcatgacatccataggtcttggttcctgcatcggtcttgtaatccatgatgaaacacgaaagatcggtggtcttgcccatgtcatgcttccaaaatcaagcgggaaaccaaatgaaagggcgggaaaatacgctgataccgcggttgaagttctgattaaggaacttacgcaaaaaggaagcaaggtaagcaacctgaaggcaaaacttgccggtggcgcctccatgtttcagaacttttcaggaaacctgaatatcggtgagcggaatgctgaagcactcaaggccatcttaaaagaattatccatcccaattgtccgggaagacctgggcgggaccattggaaggacagtaacctattatccaaaagaaaacggccggttagtcatcaggcaggctgacggaacaacaagagaaatttaaatttttttacatccctgccgctgaatcttcgattatcttttcaagcatcttaacgatatcaagcaagaccggcgggtttggcagcataaatatgttcagactgagctcatgttcatcacatatcagttcagtcttgaaaaagacaacattatcatagagaatattgctttctttaatcacaagatcaaagacatttttcgggagatcaaaaattgtcctgggtggtgagggaagcataataattcccagtaattctgcagtgccatcaagaaaggccgataccatgatgttccctatctcattgatggcactctcatccatctcattaagcggccggtcaggttcaatgggcagtccaagcatgatactggtcatctgaatgactgactcctgtgggacatggaggatgacatacccggcttttgccatctgaccttccatggtaaagacgaccatggcagaaaggccctgttcaatctgctcattaatggcatgaaggtctacgatacttatctccggaacattcagcattatgggggtgttcagcatcgtggagagcgtggttgctgcatgagaagcaccaatattccctagttccctgagcgcatctttttgattatcattcagatctacccggaaatctttgattgatttatctttcatagtattggttagcggtgctgccccagtccggggaatttgttcctcagccgggttctgttcagtatcagcggttccatcttcagggatctcatccttgtattgcatgaggatgctcatgaccggatcatcagcagatattccgggttccggtaccggctttgatggttttttctctggttcgctgctctcttctgatgaaggttcctggtcagaagagtactgggcgaggatggacataacaatatctgcttcagtctggggtttttgaggttcagatggttttacccccggagtcttttcctctggtacgggtgattcttcatataactcatcatcagtcagtgcatgtgcagttcttaccggttcagaaggagttttatcagatggggatgcggtttcccgtttaggctggccttcaaaggactggcatcgctccagatgctcttttgccaccggatcagccgcataaattccgagggcctcttcaaatgctctgcacgcaagagagtattctcccagttcctcgtatgaaagaccaattttaataaacggttcaataaaatccgggtgaatggcgctggcggattcaaaatactggatcgccgcatagtagtttttctggtccatgaggagattcccccattgcatgtacctgatataaatctcctcttcaggcctggaccggtatttcggacggtattgatcggttttcactccgggacgcatcaggagtgtgaggtttttgcgtgcgaccgggttctctgggtcaatatcaagtgctgtcgtgaaacactttctcgcatgggaaaaccttcccatttttacataggtatacccgagatttattatcgcagcaacattatccgggtcctgtgtgaaggctttcctgaataaaaatgatgcctgatcatagtccttcctttcaagggctgattcacccatacggagtagatttctgacctcccggcgtaatgcggcatccatagcaatcaatgagtatgtgaaaattccccggaaaaattaccgggtatacaggctgatagtagaattattctgtgtatagattatatacattgctcaatggtcctttccaatgcagcatttacatgacaaatacagctgcagcaagaacggttgtccaccggccgtccgggtcacctttttctgatgtgcatatatgtgatgttttgattatcttgccacttgccttgtaaatctgctcccgctcctgccatgcggtgtcaggatcaaattcaataccaagggtggttgcaagcatggttgctgcaagatcctccgcatactctcctgcctggagctgggtctccccataggaatgatgttctgaaagatagccgtagtggtttttctcctcaggaacagcaagacctatcgcagcactcatcaggcggtttggttcattggtgtcattcctggccattaccgtatacacgatctctccaggttttaacatgctcaggccttcctcccgtgatatctcgatgcaatttggaggaaaaatacttgagacattgacaatgttaaacatctcaatacctgctgatcgcagtgcggcttcgaaggatgccagccggtctttatgaactccaacccctccggtgaagaagactctccgcgggaccatcattctatatccatgagctgtgattgaccataaaaacaatccgtctgtacaggtatcaaaaaacagtcaaaaattgtgtcagcacaggtcttcagtccgtgtgtctgaattacgtagatagagcttgatggtcctatccggttgtaccttataatcttatcaggctaacacatatgggatattcaccatgaaggcagtgctcggactcgagaatggacgatatttcttcggagagggctttggagttgagggtgaaacaggaggcgaactcgtgtttacaacccagatgaccggatacatggaagctctcactgatccgagttatcatggtcagattcttcttttcacctatccgttaattggaaattacggcgttgatccagaaaactttcaaaatccgcgtgtctgggcaggggggtgcgttatccacgaactctgccggaaacccgcgcaatcacctcctctccactctttttttgaagaacagggtcttcttgggatatccgggattgatacccgccatcttacgattagcattcgtgaacagggaaccgttcgtgctgctcttatcaccgggagtgatgattggaaggcagcggttgagatggcacggaaaaccccggatatcaccgcacaatccctcattcctgatgtcagttgtaaaaaaccatggcataatcctggtaccggacccaaagttgctgttctggatcttggaatcaagacaaacatgcttaaatctctctcatcgcgtggcggcgacctctatgtctttcctcatgatgcaaaagctgatgagattcttgcctgtcgtccggatgggctcttcatcagtaatggtccgggcgatcctaaacaggcacagatgaccattgcaacggtccgcgaactgattggccagatgcctgtctttggtatttgtatggggaatcaggtatgtggtctcgctcttggtgcagactgcaaaaagatgaagttcggacaccggggtgcaaaccagccggtcagatgcattgatgggagtatttccattacatcccagaatcacggatttgttgttgacggcgatacccttccggaaggatgcagaattacctatgtaaactgcaatgacgggactcttgaaggttttgaggatccctcacttggtatctattgcgttcagtttcatccggaagcgcatgcaggaccgcatgatactgaagaaaaatattttgataccatgtttcggaggatggtctgatgccacgggatccatccattaaaaaggtccttctcatcgggtcagggccgattcagattggccaggcagcagaatttgacttttcagggtcacaagcgtgtcgcgctcttcgcgaagaaggagtttcggttgtactggtgaactcaaaccctgccactattcagacagatcccgacatggctgatgttacctatgtcgagccattacaggcagatatcattgccaagatcattaaaaaagagaagcccgatgggattctttccggaatggggggtcagaccggtctgaacttgacggcagaacttgctgagatgggtgctcttgaaggggttaagatccttggaacacctctgaaagcaatctatgaaggagaagaccgggagaaattccgtgacctcatgaaccggatcggtgaaccagtccctcgttctgtcattgtcagttccctggatcaactggagcatgcagcatctgttgtcggttttccggcaatcatccgtccggcttatacgcttggaggagctggtggcggaattgcctacaatctagatgaactccgccggatagttgagctgggtcttggaaaatcccgtatccatcaggttctcattgaagagagtgttgccggatggaaggagatcgagtttgaggtcatgcgtgatgcgaatgatacctgtattaccatctgtgggatggaaaatgttgatcccatgggtgttcataccggagagagcgtggtcgttgcaccgatactcaccctccgcgatgacgaattccatctcctgagaaatgctgctctcaagatcatccgagcgcttgatgttcagggtggctgtaacatccagtttgcctttaagggagatgatgagtaccgtgtcatcgaggttaatccacgggtttcccgttcatctgctcttgcttcaaaagcgaccgggtatccgattgcacgggtagcatcaaaaattgcaatcggcctccggcttgatgagatcttaaatactgtcaccggaaagacgcctgcctcatttgagccttcgatcgattatgtcgtcgttaaagtcccccggtggccttttgacaagtttaagactgctgaccggactcttacaaccgcaatgaagtcgacaggtgaagtgatggcaatcggccggtgtgttgaagaagccttcctcaaagcactccgctcacttgataccgatgttgaacatcacacagtcctgtcggaactgaaaatgatcctttcacggccgacagatgagcggtttggtgccctgtttgacgctcttcgccaggggatgaccctgaatgagatcgcagagataaccaggataactcccttctggcttgaaaaaattcagaatattgttgagatggagaaagccctgactgcacaccctgatgatgcaaccattctcaaggcaaaagaatttgggttttctgaccttgaaattgctcaatattccggaaaggatgtttctgaagtcgaatcaaaagttggtcttccggtatacaaaatggtagatacctgtgctgctgaatttcctgcacagacaccgtatttctattcaacctatggggataaggtctgtgaagtaacccattctgaccggaaaaaggtcatgattctgggttcagggcctatccgaattgggcagggtattgagtttgattactgcacagtacatgcggttaccgctctcagggaagatggttatgaggttcatgttgtcaataacaatcctgagacggtgtcaaccgatttcgatacctctgaccggctgttttttgagccaatgacgctggaggatgtctcacatatccttcaaaaagatgattattacggggtcatggttcagtttggtggtcaaaacgcagttaatctggcagtccccttaaagaatgagatagatcggttaaacctgaaaaccaggattcttggaacaactcctgatgccatggatatggccgaggatcgtgaccggtttagtgtactgcttgattcactctccattccaactcctccaaacggatctgcgtatagtgagcaggaggcatatgcaacagcggaacgaatcggctatccggttcttgtccgtccgtcctatgtccttggtggccgggcgatggagatcgtgcatgatgatacggaacttgcaacctatatgcgtgaagcagttcgcgtctcgaaaagtcatccggttcttatcgaccgttttttacagaatgccattgagcttgatgttgatgcggtctgtgacgggactgatgttatcatcgggggaatcatggagcatattgagaccgccggggttcattccggagattcagcctgtgtcatccctccgcagtccctgtctcctgaaattctggctgatgtccgtgattataccagaaagattgctcttggccttggagttgtcggtcttgtaaatattcagtttgcagtgcagggaagcacggtatatgttcttgaagcaaaccctcgtgccagtcggaccgttccttttgtggcaaagtcagtaggaataccactggcaaagatagctgcgcgtgtgatgatgggtgaacgacttgctgatatgccatacaaggagattgaggtctcccatgttgccgtgaaggaagttctgcttcccttcaacaaactccccggtgttgatacggtccttgggcctgagatgaaatccaccggagaggtcatggggatcgattatgactttggccgggcatattacaaggccagtattgccgctcataaccggctcccgaaatcaggaaacgtcttcatatctgtaactgatgaccttaaggatcagatacttcaggttgcaaagacgtttactgaaaatggtctctctatttatgcaacatcggggactgttgaattctttgcagaaaggggtattacggcaaaccttgtcagaaagattgccgaagggtctccgaatgtacttgatatgctaagagccggagagatcagccttatcatcaataatttcgctgacaagcagtcacgccatgatcatcagcagataatgcgggtcgctgtagattatgggacaccctatatcaccactttgcaggcggcagtcgcagctgcggaagctatcaattcagtcagggaagagaacctgacaattgaaccactacagcattatatcggtcgctgaatactctatacaaactttttttacgtgcggttttttcttcttccgacactcatatgtaggagataaaccggtgaaatttcatgggaaaaggaacagtagtacttgcatattccggcggtcttgatacgtcaatctgcattcctcttttaaaagaagagtacgggtatgaccgggttgttacggtagccgctgatgtcggtcagcggaaagaggagatatccatagccgaagagaaggggaagagatttgcagacaaacactataccctggatctgatcgatcagtttgttgaccggtgcctgatgccttcaatcaaggcaaatggtctctatgaagggtacccgatgggaacctcccttgcccgtccggtgattgccgaagcagtggttgagatagcaaaaaaggaagacgctactgcggttgcacatggatgtaccgggaaggggaatgatcagctgagatttgatgttgtcttccgtgcagcagatcttgaagttattgctccaatccgggaacgtaacatgacccgtgagtgggagattggatatgcagagaagcatggaataccggttcctgttgacaaggagaaaccctggtctgttgatgagaatctctggagccgctccattgagggtgggaagcttgaggatccggcatttcatccgccggaggagatttatgcatggacggtctcaccgctgaaagcaccagatgagccacaggtcctttcaattacatttgaagcaggtatcccggtagctcttgacggaaaaaggatgaaaggggcagaccttatccgcacggtaggacagattgcaggaggtcatggtatcggccggaatgatatgatggagaaccgtgtgcttggtatcaaggcacgtgagatatatgaacacccggctgccaatgttctgctgactgcacatgcagatttggagcggcttgtcctcacccgtgaagagtatgcattcaagcagagtgttgatgccaagtgggctcagcttgcctattatggtctgatttatgaaccgctctgggatgccctgaatgcctttattgacaccacccagaagcgggtaaacgggacggttgatgtccggttattcaaggggtcagtgaccgtgcttggtcgttcctctcctgattcgttctactcaatcgatgtcgcttcatttgattcaacaactattgatcagactgatgctatcgggtattccatgtattatggtctgcaggcacgtctggtccggaaaaaacagaaaaaataattttttcttatttgattactcctgatacctgatctattcaggcattgtccgtccaatttgagttctatcaaagtcgtggtcataacgtaccaatgtacaattatatgtttcacaaattgccatctgataagcatcatgaaaatccaaattccattgagccataatttgaagtgagcattgatgagaatgtcatctacaaaaacatcatacatctcttcttttttcatactgcagaggataagtccaatagtgtataatgaaaaatctgtcagactgagttcattcgtaggtgtttcatctaacattttccctacaacatgagaatggcgtctgtcaagaaggcgttcaagtcagatatttgtatcgagaaggaacatttatcattccaaaaacgaaaaaatctgcactgtaaaagattataataagtgaaaatttaaaaactcatataagaaagaagcgaattaatcgctctgacgtcccggctgggacttgaacccaggtcaaaagctccgcaggcttctaggatatccactaccctaccgggaccagaagtgcctgtatatgttatagctcatcactaatgaaggtattcatatctcacttttggtcttcatatgcatcctgacaatcattccgatggtctcattttcagaatccctgatagaagttgactggatgacgacatgcctgaatgaattatcactcatcttcacagcaatatgctgcctcacgccaaggaccaggctttcccggatgacatcctgaaaggtatcggtaaatacggtattctgcctggtatcgtaaaaggtgaggtatttaccgattggctttaagattatatcattcctgtgcacatttaacaggtgttccccataaggattgataaatacaattctccctcgtttatcaaggatgaaatatgcatccagctctgacagggctgcacgtgcaatccgtcggatcttccctcctttgtaatctttggacctcttcaggattcgatcattgtgcagagcaatctcaatattggagtagaggtcttttgcattgaatggcttgatgataaaactggccggttcagccatggtcgcccgctcaagggtggtttcatcatcctgaccagacagaaagattaccggtatgtgaaaaatggctgtgatgaacttggttgccgtgattccatctatctttcctgcaaggttgatatccatgaggacgagatcaggaagatgttcagctgctttatagagggcatcctctccggtggcaaccttggcacacacgacatactcacgttgaagaagaaatctctcgataagggttgctatgatatcatcatcttcaacgatgagtatctccgtcaggggactttttcttgtatcaaacataaggtgcctgccaggagtgcaatatattatcgtggacctgtaattatcagttgtttatgcctgtttattaactcttgttttatatctcattcaccggtattcccgtttggtatattggtatttttcagcatctccaccatgaaagacgatataaaaccactcgtaaattgacttaagagcaccaaactgatcgtacctccgcatcgaaaaactcacgaacagtttccgatcaaatttcacctttccaattcttctcatccggtgggcgatctcaaggtcatcgccggcatctgaaacccggtacataccggcctttttaaacggttctgctctgaatacactgttacatcccagagtgaagagtattgtcccggtgaggtatccgatatgagcaaagctattggcaagaaagagataaaaccggttttttatcgtcgcctcaatcggttttactggtccgtagagcatgacaacttccgggtcaagaaaatcctgtcttatcctgctcagccagtcaggcggaaggatcgtgtcagcgtcagttgttgcgattatctctcccctggcgcgtaaagccccgtcatttctcgcccctcccactttcgggctggtctggatgaaaacaagatctgcatatttttcagcaatttcgcgggtcttatcttttgatccaccgtcaaccacgatgatctcatactcctcccggggaaaatcctgctgtaccagggatacgaggcaccgttctatacgttcttcttcattaaatgagggaattactatggatatcatgatgttaccagttcttcgtacagggagagatggtctctgcagacctgcttaatatcatactttgctgagtattctcgtgcccgtgctgcacaggcatgcaacgttttctcatctgacagttctgcatgagcatcatcaggtgttctgaaataacgtaccgagtcctggtaaacctcatggaattcagggatatcacgtgcaatgaccgggagaccacaggactgcgcttcaagcacggcaagcccgaatgtttcggcataggttggcatcataaagacatctgctgcacaatatgcctctgcaatatcacggacaaaaccagtgaaaaggacatttttcggttttcgttgcatcatcatttttattttgaaataatctttggataacagcccgtatggaaatcccccgacccagataaagcgtgtatccggattctttgatgcaagtttcataaaatcatagatcccctttctcggacttacctgggccaccgtcaggacaacctgttcttcgggtgtaatcccccacatatccctgaatgcctcccgcttatcaggtgatggggagaagtaatcccggtctattccgtttggtattctcgtgacaggaacatcggggaccatctcctgcacctccttttcacaggcctcggagatggtgatgatatgatcaaattttcggtaaatgtcagggtatcttttattaatcgtcctggtaagggccaggttcccgatatttacccggggagttgaatgagcagtcaggatcttcttacctgatgccagccggcggttgaggagggcaatcggtccgaacgtgtggtaatgtgagatatctgcatgaaatttgtaccgctcccaggtcagatcgataccgttctgctttttcagaccacggtaaatggttcgtgcaacggttgcgcatccgatatacttgaagacaaacatgtcttccacgacaaaattgatcttcatgtctgtccatgtacaaaatttagaactgaacggatgataccgtccatattcagatactcaaactgtgaaaaccgaccgaccagggggatgccccggtttttgaaatattccctgattgtggtgatatttctgatataatcaagatcatacaccacatatgcaaatttattccgtgttatttgtgtggcaatgaccctatccatcgtgaaaagaccgagagaagagagtgatgagatgatatgatccgtaacttctgcatcagtcatgcgggatatctcatcaccttcgttgtaggtgatctcggcaaggattgatgaacacccatcaggggcggtggtatctgaaaagttggagggaaatgagatccggttcgcaagagaggcaccggcatccggaatatatgcccatgaaaaggggggaacagtcccttgtattccgatcccgattgccataaccgagttatatttcaggtcagcgactgcttttctcacctcatcgggaatagtatcaagacatgggatgagattttgaaggggaatggtgctgattatctggtcggctgacagagtacgtgttccatcagaaaccacatactgaccctcctgtcctgatattgagctgacctgaaatccggtgagaatgttttctttgataggggccgcaatggcatgaatcagcgcttcaatcccgccagtcaccgggtatgagaatactgcctgatgggtatagccttcggtctctattccgactgcagacttgatgatatcctcaacaggtggtcggggaactcttccctccatccagtgcgccgacatgagatgcgggggatagttccagatttttgtgttgtaggggatcagatatgcatcggcaatacctctcccgaaggtctgaactatccactcctggaagttttgcgggctgttatattcacctttctccgaagcgatgagggcttttatatactcatgcaggcaggtgtaacagtcttcttttggaagctccgagagtgcattttcaaaggggtatttgacatatcttcccttatagaggattttggtatttcgaaccctttcagccctgttttcaccaagtacatcgtgaataaacgataaaacctcgatatcccttgaaaagataatatgcgatcctccggtatcaaaggtaaagccttttgttttttgggatctgcacaatcctcctggacgtatctcctgctccagaacggtaacgtcctttccttgtaatgtaagaatgcgtgccagtgttaatccacacagcccgccgccaagtattaatgtcttcataatcttgaaaatggaatggtgatttttgctaaaccatgcataattcgggatatcatgatatcatatcttcaatatgtcaatacatgtatgacatataacacaaaaaaaagactgccggaatttatgagatatcagaagatcgggagatatcagaatctgtcttcagcttcatatttctcttttcggggatttaacccaataatcctgctattatgtatgtttgtaagtgactgcctgatgagatcgacaacacctgtctcaattatctctccatgtcctggatagataatatgaaattttttctttgccagttcttcaaatccgtgaacaaatgttttttcatacgtgttatcagtaccccagatcatcaccggagtatcaccggagaagagaatttcttcttcagggcagtaaatgcagactgaatcagatgtatggcctggaattgaaacaatttcaaaatgatagcggccacagctgataacatcaccgtcggtcagaatctggtctattccggttgtataaggtgatgatgcgtacactaccgcctgaaactcttctttaatctcttttatcagacgtgcgtgatcgtaatgattatgggtgagtagtattttgctcaccgggcttttgccaatctctttttttctctcacgcaggaattcgaggattgccggatcacatccggtgtcgatgagcaccccgccataagccgctccgtcacaacagcacagccatacattggatgtgtacacagcactcttctcggtaagattgaaaatctccatctcttacacaatcctgctgtggcgaatgttccggagtgactcttccatcagatgggggactctgtaggttatctgatctccatgtccggggtatatggtctttacttcagctgatacaaagagttcatatgcgtccagaaattgcgatgtaaactctccgtcatgcgagtaaatcctcataggcacatctccggaaaagagcagttgttcctcttcgcagagaatacatactgagtcgtcactgtgacctggtgcatagactgcaatacaggtttgctccccgatctgaatcttctgccggtcagcaagtggcgtgatattgtcatttctgctgagtgggtgagcatatacctgcgggctgtatttttctctgatttttggcaacatgccggcgtgatcaaaatgtgaatgggtcaggacaacctggtcgacgggacgtttcccaagaccgcacctgatactttcaagtgattcaaggattgtcgggtcccgtccgacgtcgatgagcgtattcaggtctgataatgcatgatatgtcccgcagatatgccagacattggatgtgtaatactcactctgttccgtcaggtttcgtaccagcatagatctcttttttcctgaatatctgtgcgttcatgacaatctgatcaaagagcccgttcagttcatctggaagtttctgtgtgtgctcatgaagcataaaacccccctgttcaagggcattgtagaacatcttccagacctttagtcgctcttcagcagagaaatggagcagaacatttttacagatgatcatgtggatgccggttctgatgggttcaaaggtcaggagatcgtgttttttaaactcaaccgcattgcggatttcatcggatatatagacatagccgggatctgtaggatctgttctgaagtatgcctgaaaaatctcgggagggatacgctggaggtccttttcaggatatcgtccggtcccgattatctgcacgtactggttatacgtgtctatatcggttgcgtaaatcttcacattcctgaagagatgtggccccatccgctcccgcagaaggatggcaaaggtatagggttcctgacccatggcacatccggcgctccagatggttatggtccgtctgctttgcacaaagggcagaaaatgatcaattgcaagatttaacgtctgggcatcgcgaaagaagaatgtgaacgccatgataaccttctctgtgtttttctgctccgatattgcataccctcccgatcacctgatgacaagtatccggcgggtaagacttttatgtacgcgttgttcgaaatatccgatgatctcacaatgctgatgagccagcggtctgatgtcctgatgggtgaccagaacagaatggttgcccttcttcaccacccgctttatctcagtgagtgcctgatgatagagatcattgagcccgtttccaataatggtaaccgactggccgtacggaagatctgataccacgtgatcgatggagttatcagggaacgggaggtgtcgggcatcagcaactccggccattgcagcggagaggttttttctgcttcctgcaatcatctcacggtcagcatcagttcctgctgcattgcatccgataagtgacgcttcaattaatgtcccccctgtcccacagaacgggtcaagtatccattcaccgggcagggctccagacatattaatgagtgcccggatcatccgcggcatcatgacacccgggtgaaagaatgggcggtttcccggttttctggtatgatacggggaccggtcaagctcccaggtgagttctccgaagtagcatcttcctcctgcaataactactctgaagactctttccggtgatgagactgatacccgccctttcacatggtagccgatcagtcgttcaagttctccggatgatgcgtccataccatggtctgccatctttttgactctgccgcagaagggttcgggtgatgtgatatcgaggtcctccaacatctgtataaaagactctttatctgccggacatgtcccgatataggtcattgccgcgtgagtataggcaaaccggtttatgatttctatggatggtgcctcagcaatcagtacctgggtattctgttcgaagaccggaagaattgcttttacttcttctacggggattgccgggtgctccccggataattcaaggatgagtttcactcatgctcctatggaatattgaaaaaaatcaggcggcaaatgcattttctatggtagagaggatgacttctttagtaaagggttttacaatatatcccttggcaccaagtgagagtgcctcctgtacatgagaggactgctcagaggctgtgcacataagaacgcgggcatcaggatcaatctccctgatcttctttaaagcttcaagaccgttcatatcaggcatcagaatatcaagaatcaccagatcaggttttaccttttcgtagagatctatggcaatctgacctgtttcagcctcgccgacgatctcatgccctccttttgtggccatgataccaacaagccgcctcatgtatcctgcatcatcaacaaggaggatccgcgccatgtactttgtactttttctgcagaaacgtttaagcgttgtgataggtgaggagagaatgaggggaggggttatccccctagaatagattcgaagaaccctttcttttcatttccggatcctcccgggttttttttaccttcaagttcgaggatcttttcgtagagttcctttagttctccgcttacatgttttgggatggtgacttcgacctcaaccagaagatctccaggtctgcccctttttctgactccctctcctgatatccgaagttttttgcctccctgagttcctgcagggaccttaacctccagatgtctgcggtctatggtggtaacctcaacagtggttccaagcactgcctgagccggggttatctgaatcttcgtcaggagggtatcgccatcacgatggaaccggggctctggtttgacatgtatttcaatatacaggtcaccatttggtgctccatgatccccggcctctccatatccctcaagacggagacgcatgccggtatctactccgggggggatatggactgaaacctttcttctgactttctcatgtccggaccctttacatttggaacatggtttttctgcaaccttccccttgccatgacagaaatcacaggtggattgtctgacaaaatttccgaacggggtctgggttgcctgccggatctgtccagttcctccgcattttggacaattctttgtctttttcgtctctgaacctgtaccgtcacaggttgtacaggattcagcatgcatgacctctatctcacggtctgcaccaaatacagcatcccgaagggagacttcgatccgcatgagaagatcgtctccccgtcttgggccccgctgacgtccgaatcccccgaaaatatcccctgcaaagtcaaagatatcaccaaaaccggagaagtcggcgttgaatcctccgccatatcctccaccgccatacgatccttttgaggcgttggtaaaggcttcatgtcccatccggtcatactgctgtcgcttctgtgcatcggacaggacactgtatgcctcgttaatttctttgaatttgtcctctgctcccggatctttattcacatccggatgatattttcgggccaggccccggtatgcctttttaatctcggtatcatcggcattgcgggacacgccaaggatatcgtagtaatctcccgcagccattttttatactcactccttcttttcagtgaagtctgcatccacgacattgtcatcagaagcagaggaggagctgccctctcctttctgtgctgcctgctctgcctggactttctgatatatcttggtggtaactttaaagactgcctcggtcagttcttccatctgttttttaatggcgtcagaatctgttccttcaagagcagtcttcatctttgcgatctggtcctggatgtttgtcttgtcttcctcttcgatcttatcttcactctctttcagaagcttttctgcagagaagacagccatatctgcgttattgcggatctcaatctcttctttcttcttgttgtcttcctcttcaaacttcttggcatcatcgaccatacgcttgatctcatcatcagagagtttcttactgcctttgatggtgatcgcctgttcattcccggttccaagatcttttgccgtgacatggatgataccattggcatcaatgtcaaaggtgacttcgatctgcgggataccacgaggtgccggagggataccggtcaacatgaaccgtcccagggtaaagttgtcatttgcaagttttcgttctccctgcacgacatggatctcaacagatgtctgattatctgctgcagttgagaatatctgactctttttggtcgggattgttgtgtttctgtcgatgattggggttgcaatgccaccaagtgtctcaatggacaaggtcagcggagtaacatcaaggagtacgatgtcactcgtttcaccggcaagtacgcctccctgaattgcagcacccactgcaacacactcatcaggattgatgcctttatccggttcctttccaagaagttccttgactttctgctggacaattggaacacgggttgaaccaccgacaagcaggacacggtcaatctctgatggcttgagtcctgagtcggagagtgcctgcttcaccggtccaatagtactctcgacaaggtcggagatgagctgttcaaactgggcacgggtcaggtcgatgtcaaggaattttggccctgatgaatcggtggtgatgtagggcaggttgacattggtcttctgtttttgtgagagttctatcttggcattctctgctgcatcacgaagacgctgcattgccattggatcttttgaaaggtcaataccctctttctttttgaattcggcaacgaggtaatcgatgattcgcttgtcaaagtcatcgccaccaagatggttatttcccgaagttgcctttacttcaaagacaccatcaccaagggtcaggatagagacatcgaaggtcccaccaccaagatcgtagacgaggacggtgtgatcatcttctttgtcaataccatatgccagtgccgatgcggtcggctcgttgatgatacgaagaacttcaagccctgcaatcgttcctgcatccttggttgcctgtctttgtgcatcgttaaagtatgcagggacagtaatgactgcctttttgatctcttccccaaggtatgcttctgcatcggctttcatcttctgcaaaatcattgcagagatctcctgaggggtaaagctcttcccgttgagttcgatctttttggaagttcccatatcacgtttaacagatatgacggtgttcttgtgattggtgatcgcctgacgttttgcaaggcttccaacaagccgctcaccctcttttgtgaatgcaacaacagacggagtggttctgcctccttctgcattggggataacgactggttttccaccctccatgatagccatacaggagttcgttgttccaagatcgataccgagaattttttcgcttgccataatgaatttcctatatatgaatgattacttctgttcgactggtgctgtaccctgcgagacaacaacctgggcaggacggatcactttgtcctgcaggcagtatcctttgcagacctgatcgcagatagttccctcatcaacatctgatgggatcatcgcgatcgcttcatggcgggttggatcaaatttttcaccgactgactcgaatgattcgattccctgtctcttcattacctgaatcagcagcttctgtatctgagcaagcccttcgtgtgctccgccctctgcctctaaggcacggtccagactgtctgccacttcaagcatgtcacgggcaaattgtccgatagactgagcaatccgttgttctgtatcccggacggaacgttttctgaaattttcaaagtcagctgcaagccgcaaatatttgtcattgaggtcatcatactctgaccggagtagttcaaggggacttttctcctcttccgggggtgatccttccggaatcagggcatcctctccttcctgattcatttctgattttttctcaagattggtatctgcggaatcgttcatagaggttcaccataattgttgtaatgtggttctatatatatgtatctcgttctacctgatgtctatgtattaatgtatcatcactgaaaatcttaaattctccaaatatctcaattaatcaaaattttagccattaaaatctaataaaaattatgcgagagtatttacttgaagttagtgtaaaagcatactcatctcctttgtatgaaacccaaaaacgcgccggtaaaaaatcaaataataatggtttaaattagaaaatctctttgctatatatcttattgatatactccccgtcaactgcggggaggtatcgcaccatcgtgtcacccgcaggaatagtggtaacctgccataaacgattcggtttgaaattcacagaaaaagtgcatattggatttaaaaatcttaatctcctgcaaattctttcgcgctccagtggaaatgaaggggtcagttaattcatatgcccgaaaccgtctgcaccccctctcgtgctaccctgacagaatcctcccaatacatcctgggacatatgaccagttcgtatccgcagtcttctggtgattatggtttattatatcatgaaaatcaggcgtatctgtatggaggaaatgagtgagcctgatctctgatctgctttggggatctgccggaagaatgatctgatggataaaagcatcccatgtggaccggttcaatattccggattctcttacttttgaaaacagaatcatggcgtagagctgaccgacaggatatatccagtacattcctgcagtatctccagtcaaatgcggggactgaagaagataacccccatggtcagtactatgtattccagttatttctgtatatatttctgcgtatgcttctccaaatgaaatggaatcaggggattttgtaaaccggtaatcaagaatgcctattgccatgtctttccccaggttcaaccgtctttctggagaatatggatcggacattattgaatattgcataattttgtctccgttctgaggttccaggggggattccggagccatgaggatgcttagtatttccggagaaaatgccagatattcaaaaagatgtgataaagcttcggtcagttctacgggcattatggttggcaccgaagatgtttgatcagaactggcaaggatcctggtatagagatgacccagttcatggaatagtaaggaatatccttctttttcgagtccatttcgaacagtattgtgatccagaatgccactcacgataaatactggtgcaggaagacccccttcatcttctcttccatccccatctccggctatgagtgcagtcatccactctttggttttccctggcctttcttccagatcaagatagaaccatcctttcgtatcatttgtcttttcatcagcaacccggaagaggagaacatctggagcgtacccccgggcatctgccacgagttcagttctgacaccaaacaggcaggagaataatgcgatggttcgggatatcgtaacatggagtggtaatgaaaaatctctcgtatttggggagtcatttctctgttgcgaggtgatgagcagatccgtctcataatcaaatacttcttttgccattggatctctggttctctttctttggagaagatcagacgccaccggttttaccaggtctttcacaaggggcgtgatctcatcgagcatggatgaaatgtctgtcccgtttattctccatccctgttcatctgctttcaggtcggtccaggttgtatacccaagaagggatgcgatagaatttcgaagaatcgcagtttttgtgaatatattgagattttctgtaagagggtgtttttccctgatatgcatcatgtactggttctgcaaggatccaagttcctgatagagagatgataatcgtgttttctcttcttcagatctgagggcaccaccacatctgaaaaaccggatttcctgatcatacaaccatctcccatactctgactccggttttgtatctaatatggagcggtacagttcatcatgtgatgaaaggttcctgatgtatgtatcccgtttctctgctgccatgaacgctgtgttctgaagatcccggtccggatacaaactggcaagggtctgatattttaaaagacggttatcaagtctggtcagaatctcttcaagacggagtattgtatttgtttcattccgttcacaggcaggaagagagagaagagatgcaatttcctggtcagtctgggagagtgcactatgtacttcctcctcaatcgcctgtgcagtcgatggaaaggtaatggctggcttttctccggaaacagaaagggaattatcgattcgatctccagatacctggctatagagaagggtaaggagtaataaaagaacaattaaaaagtcctttttattcagattctccacggttctccctcttgatcattgaatggatactctgaatcgatggatacttatagccttaatgagaatagtccattcagggaagatctatgggatcacaaggacgtaaaattgtcggcatggatgttgatgagttgatctctctcctcaacaaggcactcgctgatgaatggcttgcatattaccagtactgggtcggttcaaaggttgtgaaaggaccaaccaaggatgctgttattgccgagctggtccagcatgcaacagaagaactctcacatgctgatatgatagccctccggatcgttcaactgggaggaaccccggttcttgagccgaaggaatggtacaatctgactaattgcgggtatgatgcaccggttgatccctatgtgaaggccgtgcttgagcagaatatcaaaggggaacagtgtgctattaagacgtatgacaaactgatgaagatggttgagggcaaagacccggttacgtacaatatgattctcaccatcatcactcaggaagttgagcatgaagaggatcttcaaagtctccttgaagatcttgaaatgataatgaaaaaataaattttttttgattatcttttcaccttttcaatataggtttctatttgttcacaaaagacgtatagatcttccaggtggtttttcagaatatagtatcctgtttcatcatcgatcttcccattgcgatggacaagaatatttcgataactcttcattttttcatcgtttctgaaaaattctgatcaataattccttttgagcacagattctctatgatgtcttcatcatcttcaggcactccaaaacgtaaatccctgtttatgatggcgcagatatcaaaagccgtcttgatggcatattccaatctcttgaggatagctaaaacccccctttggtgatcgcaagtttataaagtatttgtaaacccacatttgttggaagggagttattagctaatctctcttataaataccctcctttacaatgcccatatttgaaaattgttgatattcacagtcgggaggaaaattctcttttattatctctattgaattctctatctcacgtaaacggattcgaatttcttccaatctcatttttttattcaggctatgaatcgttctccggtatagtcgtcaagatgaggtttgaacagattgtattcccggatggtatcatatgccaggtcatacacttcatcttcatcctgcatatacaagaacacccctcccagtactgactttcggatataaagaggcaggttttcaaagatgtttaaagctatcttttctggtagctcggacaacaatgatattcgatacaattctgcttctaatcgctccatggtacatgatatagtgatatcgatgtctgagtggatggtactctccccggtggcgactgatccatagagtgcaataaatcttatctttgaaaaatcagttgaatttttcattatttcgagggctttttgaatgacatccttgttcgtatcttttattgcagggttcatgaggatcttggataataatgatcaccggtactgaagaatacataattcaatcttcatgccatggtttttcataccataggagaacatatacccttgtaggtgtaagatcctcgcacttggtataccaatatcaaaatcatcatctggggagggtactatgaggaaatatatcacacaaaaaggaatttttctggcactcatctgtattatatctggtatcagtggtgtcggatatgctgatcagggagataatttgtattatgaccagcagggttcaggtagtgcagaacccttttatccgtcatatgtcccctcccctgatacagatcttactccggaccaggatatgcagattatcactatccaaccaggaatggagtatgtgtataccgacccttcaccatcccccgacttttcacctccttcctcgtcgataccaaatcagccggtcttctcacatgatccggttgggagttcatatcaggatccgggaactgcagagccctattatccgtcctctcctccttccccaggaaatacctatgaagatccggtgcaggttgtaccggtgacgacccaatacccggaccccggtatcgcggttccgtattatcccgcatacccgcctgaaccagaaccgactcagtatatccctccacgtgaatactcttccccggtgtatatcccgtctccccgataccaggagccagtagttatccacacatggtatgatgaccggtactatcgcccatcctattatgatccatatgatcgaaaatgggagtattactcatacgcagatggtactttgaaagtatccagtactccatatcaggctgaaatatatctggataaccggttcagaggctatactccgtattccggctaccgaaccattgaaaatctccgccctggcacctataccctccgtctgaaaactgccggctactatgattattcagaagatgtgtacgtgtcacggggcaggacaacttacgttgatgctgacatggtaagaatcggggaacggtaccagaaagcaggatcgatatctgttcaatctgaacccccgggtgcaggtgtgtatctgaataatgagtaccggggctttacaccggttgtcctcacaggagtatctccagatgaacacaccctccttgtgcgaaaggacgggttcatagactatgtcagcaaggtgcaggttatggataaacagacgatcagcatttctgcgatattaaatccggcgccggtacctgcaaccttgactcctgttgcccctccagtggagagtcctgttccaactcctaccaaatccggattatttgagggtattgtctgtatttcagttcttctcagtgcgcttttcatggtccggcaccggtcagatccatgaaggcccggacaccttttttcgaaagcttctagaccttcagacagagaaagtactaggataacagcaggaagtcggtgtagagtgagtacaaaccctgaaaaacatcctaaccgtccccattgtctgtacctgtggtttctacacggaatgccggtatgttctgaagagaaaagcaatcggcagtgtccgtatccattctggaaatgtccggtaaagcagatgcagccagatcagattcatatgatggctgcggatgtggtatctgatgtatctgatagtgccagagtgtccttgaaaacatagatctacagaactcaataatcccgccgaatctttgggccggcctaccgggctaaggccaccgtctctccatattgaacgacatggcccttcattgcctgaatgagttcatcttttgttgatccggctggcagatccagcatggtatccagaccataaactctgaactgataccggtgcatctcaccttcaggcgggcagggtccctgatatccgatggtgccataatcatttcttccctgcacggcctgtaccgggtatgttacctgcggctcttttggaataccttccgggattcgggagagggggggaaggttccagacaatccacggagtaaaggaacagcatgatttgatgaacggattaaacaccatgatagcgacagaggtggcattcaggtttttaatattcaatgctggagtccggtcttctcctttgcaggtatacgaatttggaaattccagaaaatcaagggttacaattattgaggttatggtggtcatgctggatcatacctcatatcagcgtgccaggaaaaaaacctaagcctccggcggtaatgagatccttacggttttctgccctgattatctgcgggatatctccccatatgatactttgttctccaaacacggcgaatattccgtcgatatgagaatccaccctgtcaaggcatgactgatcggcaattgtcaggacattgcagacggctgttgcaacggcatctgcgagaagaggatctcttgagaagaccgttacgctgtctgccgttccaaatgaaaaggaatgaccaaccgttgctgatgaggtgcatatcccgtatatctcatttttaggtgggataaaaaatgcatatttgccagataatggagaatttcccgcatacaggcccacccgtaccggccggtctgttatcatcgcaatatctcctccattatcaatgatacaaaaggatgctccctttttttgtgctgcgctcactccggcatgggcaatcgctccggcaaccgctgccattggccccacgcccgctttccatgcggcagcagccatgttcttaataatatccgggccctgtgtgatagtcaatggttcaaaactggaattaaaaaagggatcctgaatgatataccgctcaagttcgtatctggccgttcggattccttcacaagcggtttcaatcaccagctcttcatcggccagaattgtggcaattgtctccctgagctcaaaatgatgacggagggtcattcaggttagtaacttaatgataatgctgcatggggacaactgataatacaccgtccacagaggatacatctcttcgtttcaacatgtaatttccattcttcatcaaaggagaagactctttttgggcaaatagaaatacatgccccgcagtcaacacactcctcctcatcatgtctgataccttcctcgagaattctgacctcagcaccaaggcttctcatccgctcgctgaccaggatgcagctttcgtctgggacatccacaagggcttcttctccttcatgcgcatcagatcgtgcccggtcaacattgatgagaacgccggtttctttgaccacctgggcaataatcggcttactctcatgaataagcctgactaataacttcatggtcttcctccgccgggtttgaacagtttccctaagtcacttgcatgaagaatggcaatacactggttttgtgcatcaacaaccggtaatgcactgatgcggtgatgttccatcttctgagcagcaatatcaatcggttcatcggccaacgtggtgatcacatttctggtcatgacatcctggacttttacctttcgttcaggccgtgcaacagccttggcaatatcaaaggtggttacaacaccagtgagccgtccctgttcattcagaaccggcaggtgatttgtctctcccctgaggagtttctttgctgcctctgtgatctcctgatcttccttgatggtgaccacttttcgttgcatgatctcctgaaccaggactacctttcttgtttccctcattggttttgcctgttttgagggatcaagataccgggtagggaggcaaagggtcatttgtccatcctcaatccatcgttttaaagtgtttgcaaccatctttgcccggcggaatgatgacagggatgaagtcttaatctcttcattatcgagttcgatggttcctgacttcagttcagcataactgacctgaccaagaaccggtcggctccgtgaggggactccgtaatccttgatactgaccataatatcctcatcacgaaccgcagtgcgcctgacagtttcgatatcaagaaccggcaggggaataccgacaccaaggtagagggtcgggccgtaccggtacatatatgcagccctgagaaaatcggtgttcatgtcattcatatcggccgtggtcattaaagtggcaaagttccctgccgaggagtgctgagttccttcaccaatcaccatgccctgagctccgccaaggaggattggaacaccacttccgattagccggaggtttggatcattgcatatgggatttaatgtgccggctccggaaaaggtaacgtttccattatgcggaagaagggttcccatgtaggtatataacgtatcttcagaggtgttgactgcagcatcataccgctggtacgcattccggggattgaccataatggcctggtttaaatcttccagtcgcacctcggttgtgatactccgccgtggatagcagtctgatcctgaagactgggctcgaagttcgatggctttcccagatataaaatcctcgataacatgggctccaccataactttccattctggttactgacttgtttgtcgcaccgatgtaagtatccacagctgcaataccgccatatgcctcgacatcgttcagccagagtcgttccatctttattggaggctctgcatgaccgaaattcaaaaaggcaccagaggaacacatagccccaaaggttccggtggttacaacatccacctcctggagtgctccttcttctccgagttcgctgacgatgtccggcatctcatcggcagtgaccacccgggctgttccatcacgaatacgccggttgatctcatcgatggacttttccataatggttacctgattggagatgaaaggtgttataggtttagttttgcttctgatgggaaaaaacggacttcgttcttttaaagccagaaaaaatattattggaggacggcaccaaggtcagcagggccgactgcagcagcatacctggcaaggacgccagtaagcggtctcttgagtggtttccatcccttcttccggttctcgatctcatcagcagaaatattcagattcaccgtcttggtaaacaggtcaatagagatctggtctccatcctttacaaaggcaatcggaccgcctgccgctgcttcaggtgccacatggccgatacatggtccccgtgttccgccagagaaccgcccgtcagtgataagagcgaccctgctgtatccaagtccgacgagtgccgaagtgggtgacagcatttcaggcattcctggcccgcctttcggaccctcatacctgatgacgatgatatccccctcttttatctcacgtgcaaggattgctttcattgccagctcttccccgtcaaagacacgggccggtccggtatgcttccacatctcatcctgaactgccccgcttttaatgaccgccccgtctggtgcaaggctaccggttaggatcatcaaccctccgctttggtggactggcgattgttcgggtcgaataacagactcatctacatatttgactgaatcggcgatagtgtagatatccatgccggatacggtctgacaattttcaagatggctccttatctgcctgaagactgccggaattcctcctgcatggtggagagcttgcatggagtgaggaccagccggcatcattgatgcgatatgtggtatctgctctgataaccggttaaattcctgcaggtcaaaaggtactcctgcttcagttgcaatagccatcagatgaaggacggtattggttgaaccacccagggccatatcaaccctgatagcatttcgaaggcttgccggggtgatgatatcacggggaaggatctgttttcttaccagatccacaatccgttttccggttctgtatgcaagccggattttatctgcatagactgccggagttgcggcacacccgggaagtgacatgcccagggcttcagtcatacatgccatggtatttgcagtatacaggccctgacatgaaccacaccctggcatcgcagcagtttcaagttcggtgagttcctcctccgtcatggtccctcctgccacctttccgactccttcaaagacatcagtcagtgagagttcacagccgtggagatttccaggaagcatattacccccggtcaggacaatggcagggatattacatcttcctgcagccatgagcataccaggaacaatcttgtcacacgtgcagatgcagacaataccatcaaacttgtgggcctgtatcatgagttcgactgaatctgcaatattttcccgtgatgggagggagtaccgcattccttcatgccccatggcaatgccgtcacagatgccgatggtattaaattcaaaaggagttcctcctccggcagttatcccttctctgacccgttcaccaagaacccggagatgggtatggccgggaacgatggtgttccaagagtttgcgataccgataaagggctggtgcatctcactctcatctatcccgagagaacggatgagggaacgattgggagcccgggcatatcctgccttgacatcatcactccgcataatactcatgaacagataggagatgtcactaaataaaggaaaggtaggtggtgcaaaatagggtgtcaaatgcaccacttagatcggtgagattcagatcacatggtgcatatcaatcgaaaacctatactgagtatggtttttacctgtgctcaatgtggtcagtgctgcatgtacctgggagactatattgtcattgatgcaaagaccgggccatataccttttcctgttcctgtgtttcaacaaacactccttttcatgccgtcgttgatgaggataaacgaaaattttttgataacgatgagtttccccgtgctcatcctcatgcctgtccttttctccgaccgactaatgacgggaggatcgtctgcaccattcatgagaccagccctgcccagtgcaagatataccggtgtgtggtagtgcgaatttactccggtgaaaaacaggtggggtatatcaccggtatgggtgcacttcattcagatgatccggatttgcgttccctctatgaattatgcgccaagcaaattccgcagggggatgaggaacgggatgaatggtttgcccggtactttgaaaaacatgggtacaggactgaatagtggtatcaccgcgagtcaagccacggacctacatctgcagcatggagaatctttactccgatatttttcatgtcaagcacgttggcttcatggatctcttttgtctgtgccccggttgcgtcatcgacgaggatcgtttcatagttaaaagccattgcatcaaataccgtagtccggatacagttcggtgtctggattcctcccacaacaacgatgtttaccccgagggtccggagcatcaggtcaagggtagttccaataaaggcactcatccgtaccttctcgatcaggtgctcacctgggactggtgtgagttcatcgataaccgcagcactatgtgaccccctgactgcaaatggtttgtctttaaacaggtcagccctgaaccattcaacatctgaaccatccggttcatgaaccctgacgatatggaaaaccgggagatgttttccgcgaaatagagaaagcaattgagtaaggggggtgatgactgcctgtgctccggcaacagggagaactgcatgagctgaggcaaaatcattctgcatatcgatgatgaggagtgcaggtttttgtgccatatatatggatgggattatggtttcatcatagttgtgactgggtcactgagaaagcgattatcaagatacgtcttcaggtggagagtaaaaatagtttttttgggcagtatcatccggaaattgttcgaaccataagttggttaaatactaggcaatgatgtgatatccatgaggtttttcgatattgccatatggaaaaaatgatgaagtattactatgagtacaacctctccctcatcccttccaattgttctatcagaattgaatagccatattgataagataagggggacgtatggggtgacaagacttggagtctttggctctgtcagccggagagaggatactctggatagcgatattgatattctggtggattttccccctgaaaaagggatatacaggaaatttattcatttggcagatgaactggaagaaatttttggccggtcagttgatcttgtaaccgtaaaatgattatccccatttatacgaccatatgttgaacgagaggtgatttgggtttatggatgatatcatattcctttctcacatcctggaagagactcgggtttttctctcaaggatggctctgatcctttgtatcgtcctttgcatgattggacccattcaggcagaacgggtattcttctctgatggcacgttgtacaatggttctctatcgaaagatgatattctgaaacagtttgaagaatacaccggtgagggaccggtgattgtgtttcatgatctcatctgtcaatcatgtcaggatgcgatggattatttcagggaatttgagcagatttacccggaaatccctattgtatactatgaccttcatggcaacacgaccaataaactgctatttgaagagtacatgacgatctatcaccaaaaaaacctccttgcaccaaccgtttttgtgggtcctgcagggattgaagggaatgagtcaatacggctggtctttgaaccgtttgctctattatatgtagataatcagtgaattttataaaacaatatttcgtgtggcgtttcaaatcgtcaggaattagtctcttaaaagcgcaccacgctataagaattgtgataccatgtccccaataagcgagagagtgaccaggaagaagaagatagatccactccttcgcacattcggatgggacattttttttacgatcatcttgaggttgaacgggcatttgaaagcggtcttagtcagatgatcaccgatttcaatatggcaatctgtgcagaaggatgagttatggggttaggtaatatatactgccgccaatatgtctgtggtttagatgagatcagaggaataacatgaaaatctgtagtctttcactcaagggatttcgttcttttaaagatatttcatggtcacccgaaagtcttaacatagttattggaccgaatggaagcgggaaatcaaaccttctcaaattactggatatgattcgtctgtatgctgatggagaattcagagattatgtccttcgtgaaggagggagggatcagattctttgggataatcaggcagagaaaatagagattcatatcaacttttgcagagatggggaccatgaacaaatcgcctctttcgatcttgaatattctcttcagattaggaaaaagggatatgagggagattttcagatcgaacaagaatttttacgtactatacatgttccttctgaacttcatgaatctgtcactttttagaacgaaatccttcactctcatatttccgtaataatgtcgacgctgattcaatctcgatggaaattgaatccaccgagacacttttatcacaattaaaaactccatttacaaaagattctagagggtgttgcatgactaaaatttggaaaatttttggtaagtactttttcttatcaacatctttagaaaattgtctccgatcattctgcccaaagatgataatgcatcggacaatattgaataaggtattctaatacccactcccttattacagataatatgccgcttcttttgcaggatcagttctctgaatttcttcaactcccctcttgaacagaccttccgaagattctgtgttaaacaaatcaaactccattcatcctgacaatgtgatattccccttctctgcaattttcttaaattgcgattttctttaatccatccaaatgcgggttcaacaatcgtttttcgttgtgaatatgtctttttggcaccatacggagtcattgtcacttccataatccctttagcaatagaagcgggtgttggaatattatcatcttgaatgagatttctcgtacaccaatcaccaatagatgctaacgttggaatactgcaaatgccatcaaaaagttgatcggaaattcgttcaagttcaagtaaacttctctcgaggcctctaatactgaaaatatctggttcatggcatgtagaacagagaaatccaatatcctgctgtttcatatacagatagttttcatagctccaataaccagcatcagtaagtaaattaagatattcaagcgataagccggttaattgagcaatttcctctaatctttcataacatggttgaagtaatctgtaatcaacgggtgaattacttaaaaacggaaccagaatatagccatcctggtttacaattatctggccattatatccttgaatacaaccaggcccacttttcattattgaactatcaggatctgtagtgtttgcaagactttgttcatcagggttttttgcaggctttttaggttttctacctcgtttcctttttccagactctctctcctcttcctccctttgggcaatcttctcttcctttttttgggatttctccttatgttcagcctcaagtcgttcttttgcttgaatgaatcgttttatcctttttgagtgagtcttaaaatcatcgggaacctcgttacctgatttatccgggccataaagacgatcctcgacatcatctttttcttggacttcctttagatatttttgaatttctccctcaatcttttcatatggcatgttcgatccaagtgaagcattcgcctttagttttgttccatccaaggcgagaaggacgttattgattaatcctgcttcattaaggagagtcaatactggaatgaaaagttgtccaataaaagaactgtttttcttgataaatcgcgagattgtggaatggtctgggagagaattgcgggttactattctaaatcctacatcgtatctgcatttattctctatttgacggcttgaacgaactccattaaaatatgagtaaatgatcaaaccagtcattatttctggatgataaaatgccgcaccttggccgtcttcccggtattccttatataatggggataggtcgagaattgagattaaatcaattaatatatgacagaaatcatcactcggaacccagtctctaatatcctcagggagaaggtaaagttgttcaaaatcccgacctatcgtattatacattgagtatatgttggacgtactaaggtaaagtacttttgattgaccttagttaaaaaattatggggggatctgagttgtgcaacaccctctctattccctcaaaattacagaagttaatttcttcctggagaatttttcagtcatagatacttctccccattcaccgattcgcaaaccgacgatatcaagatgtgatactgcccttttcttagatggaagtaacctcatctcagtgcgtcacactctctatacaaccaaccgtgaatttgaacgatcaatagaccttgcaatggttgcagcatttggagaagattacgataaacttgtttttcccccagctgcggataaacagatccagctcaggatcaggtggaagactcttaaacaggagcgatctgcatcagatatttcagatggaaccctccggtacctgtttctgctcacaattctggctcaccctgattctggttctttgatagcaattgacgaaccggaaaccggccttcatcctgctatgatgcggatagttgcagaatacgcaaaagagatgtcacaacgaacacaggttattattcgcactcattcatctgaattttttacggcctgtggggggtttattccgagcactttaattattgaatggaaagagggtgcatctgtgatgcgacaagtttccgaagagaagcttaaatattggcttgaatattatacgcttgggtccctctttttctcaggtgagcttgaggggatggaatgagatttatcctgattgttgaaggcgatactgaaaaaaggtcaattgaggggctgatcagaaagcatcttgcagaaaagaccaggcagaatatccgggtaacagcgatttatatcaacgggtatgggaattaagtcctgatgggaagggtggatccacagaaggtatacgaaaaatgtccgaattatcgtgcgatgattgattttttgtttcacttgtttgaactggttgtgtgattgatttttatgaccgacgttgtcggcaaactctggggtttttataatgcgcccggataaaatcactccttcagtcttactttcaaaaaaaaggattttttcgctatctcactcctctctcacacacccacatttccgtgccatctctgcaaccgccgctgccaccacctgggcaaccccccggtccaggggatccggaaggattttttccggtgtcggatctttcacatacagggcaatagcatgagctgcagcaatcttcatctcctcacttattttcgttgcacctgcatcaagagcccctctgaacacacccggaaacacaaggacattatttacctggtttgggaagtccgaccggccggtaccgataattgcagctccccctgctcgggcttcatcaggcatgatctccggagtcgggtttgcaagagccaggacaatcggatccggattcatctgccgcaccatatcagccgtcaccaggtttcctgatgaaactccgacaaagacatcagccccccgtaatgcatcggagagcgttccggtcctgagcatcttgttcgtttcatcaccgagcaggtatttgtagatattatgatagagcccgtgacgtccccggtagatgatcccttctcggtcacaaacgatgagttcttttactgctgtacatgtctccccttcatatccgatacatttcagcagccggcagatggcatatcctgcagctccagcacctgataccacgacggtgaggtctttgaatttttttccggtcaccttacaggcatttatgagggctgcaagaactgcaatggcagcaccatgctgatcatcatgcatcaccggaataccgagattttgaagttcctcttcaatctcgaaacaccggggagccgcgatatcttcgaggttaattcccccgaataccggtgcaatgctgcgtatatgaccgatcagatcatcatggtctccgttaatacagatgggaaaggcatcaatcccggcaaactccttgaagagaattgccttcccttccataactggaattgccgctgtcggaccaatatttccaagtcccaggacggcagttccatcggtgatgatagcgatggtattacgttttaatgtacaggaaaatgcccgtgtttcatcctcggcaatgtaccggcagacatgagcaacaccgggagtataggcaagtgagaggtcctctctggtctgcaccgggactttagactgaacagcaagttttccctgatgttccaggtgcagtgccagtgatttctgtgcgatctcctcacggtcaatatccatgaaatgagagtctcatcggttggatatcaatgtttggaaatgtcaaagaaagaaaaaaaaggatcagggttcgcggtagggattgacaattcgtattgttggttttgcactctgaccgttctgccgtggtgctgcggtctggaatgtctgctcttcagacataatacttgacttactgacaaccatgtatccccgtgaatcaagggcatactgaaccccttcctgcagcgttgcgcgggttacgatatccttcaggtcgataccaagttttaccatcatcatggctacttcaggttttacaccggtcatgataacctgggagcccagaagtttgactgccgtggttgccttgatgatatgagttgccaccatctcgtcgatgtgggtgattcctgtcccgtccatgataattgatctggcccgttcacggctgatggcatccaagagttgctcgatcatcttatttgcccgttcggcatcgagcgttccaatcatggggaggacaaggatctcatcccatatcttggtaatcggagtggagagttcaagaattgcagcattcttttcacggatggatatctcggctgccagctgatcactgatatcttcaaacctaaccaggatctgatcctcatttgaggagccgtaccgtctcatcaccccggcctttacaatgaaggtctttttcccctgcgggatggggatctcgacctcaaagtgtttgacctcattaccagcatttttcaggctttccagggtctgtctgatcaccggaatattcaggattccatttccgatttcatagactgatctgccttcgatatctgccctattcaccccgaacgtctgatcaaaagcacggttaccaaagacaactgcatatttttcatttaatacaaaaagaggttcatcaatcgactgaattatctcaaatggatcaacattgagggtcctggttgacatatagatgatctattctcaccggttgatgttattacttttcattagatatctacatcacagatacaacggagatcctgattacgtatgacagaaaataatcggaacgaatttacgtaaaaaccgggggttgccccggtccggaggaggatagcgataatgaacgctgtaagttcggagcataggttatccggcgaccaaaccggaaatctctcctgccacccggggggatggcggtgtgataagtaatactactcaccacaaggttatataattaacgtaagttccatcgacatatcacgaacgtgcctatatgtgggaggtatggacaatactgaaaaaagagaaaaaaaggtaatacgggggttaaatgattaagccgggacaaatttcgtcccatagaagattgcgccgctggatccgtcttctcccagttttctgaagacccgtctgactggcataccaatatacacctggtcgatatcacagacaaggtgagaggtaagccgggttccttcatccagctcgatgatggcaagcacatacggagtcaggagtttgaaattacctgatgaactccggatgatagagtatgtgactacctttccggttcctttaaactggtggtctacgatcttaccttcacgtctgcaatccggacaaaatccccggggcgggtagaaatattttccacaggtcgtacatcgggttccaattagattataccggttctgctgttttctccagaatcgtgcgactgacatcttataccctcccaaagatatgacagacaacggtggctccggtaccacccacgttatgggtcattccgatttcagtatcgatctgtcttccctttgcatcgccacgaagttgtttgaccgtctcataaacctgtttaacgccggttgctccgaccgggtgaccacatgccttcagaccgccacttgggttgatcggtatctttccaccaattgcagtctgtccctcttcggtcagtttgcctgcttcacctttcttacagaatccaagatcctcaattgcacagatctcagcaatggtgaaacagtcatgtacttcaacaaatccgatatctttccgttcaactccggccatctgaaatgcccggttaccagcagcaacggttgcatcgagggtacagatatctttccggtcatgcagggcgatggtacttgatgcctgtccagctccaaggaccttgatcggagtgtcggtaaattcccgtgcccgttccaggggagcaaggatgactgctgcagctccgtcggtcaccggtgaacaatcaaagagccggagcggatctgcgacaagtgttgaattgataacggtatcaagggtgatcggttttctgaactgggcatttggattctttgcaccgttatcatggtttttaacggcgacctgggcgagttgctctcttgtcaggccgtaccggtgcatatactccgttgcaatcattgcatacaggccggggaatgtaatacctgctattccttcccattcccggtctgctgctgcggcaagaacatcagtcgtaacttcggttcctacgtcagtcatcttctcaacaccggccgcgaccacgatatctgacatacctgatgcaacggcggtgtatgcctgtctgaatgagagacctcctgatgcacaggctgcctcaacacgggttgccgggatattatctgttgcgagacctgcataatctgcaatcaaagccccgatatgttcctgctcaacaaacctgccggcactcatgtttccgacaaatatttcgtctatctgttcaccggagaggtttgcatcctcaagggcaagagctcctgcctcgacaaagaggttacggaatgacgattcccacttctctccaaactttgtacagcctacgccgattactgcaacttctctcattccatcatcaccactttgcctttgtgttttgcatagactgcatagtctacgatcttcttgtctgcgaggagagcagagaccgatggtgcagcatcacggttaaagaggtcagaattgataacatcagtgacggtgatgtcaaacgagtcactcccggagccagacccgtatgaagtcatgaagatccggtctcctggttttgcgatatccagaaccgatgaaagaccgaccatggaggcaccggagtaggtatttccaagataggtgaccgcaagaccaggttttatctgctccatggtaaatccgagcattgatgctgcctggaccgggaatttaccgtttggctggtggaaaactgcataggtatagtcagatggctttgttcccatcttttcaagcatcatctttgaagcaccaatgacatgcttaaagtatgcaggctctccggtaaaccgtcctccatgacgtggataaggcttgttttcacgtctccagaagtcaggggtgtcggtggtaaatgaacaggtatgattgatttcggcgatgggatcgtcgtttccgatgatcatcgctgctccaccggctgcagcggtatattcgagtgcatctcccggttctccctgggcaacatctgcaccgactgcaacagaataagtaaccatgccggatttcacgagacccatcgaggtctgaattgcggctgttcctgccttacaggcaaattcgtaatctgcagcggtcatgacgggggttgccccgattgcttctccgacggtaacagccgtaggtttcaccgcgtaaggatgcgactctgatccaacatataccgctccaatgtctgcagggttgattactctccgcgccattgctgcacgggcagcttcaacggagatggtgatcgtgtcttcatccatatctggcagtgccttttcaaagacaccaaggccacgggagatttcagtgccatttgcaccccatacccgggcaatctcttctactttgatacggtaccgtgggatatatgcaccgtacgagatgattcctaccatttttcttccctcagtctctccacgatatcttcgatgccctgtgtggtacacataagggtgatattatccttctcggccatttttggcacaatcggatgcacatcaccaaggctgataccgtgaagcactacgcaccggggcttgaagggagtaacccggatagccaccatcggtgactttccattagaaactccggtaaaaatgagcgcccgctcagtactccagccgtatatccggttaaattcgcttgcggtcaggttcattatcgcccggagactgtcaattaccgtgtatccataaatgctcagatgcaccggaccggtaatgatatcagcaccaatgacactggcgaatgttgacagattaatgggacttttataatcatggagatcataaattacaccgtcccccatctctgcaaagaggagggatgcatatttatggatatacttcccgccctttccttcatcaatggctagaatactgtcaacaattcgtccgataatggcagtgcccggactttttctccttccgctttcatagtcactaatgactgatggcgatacaccaaggtactcggagagttgtccctgagatatgtcaaaactcagtcgccatttcttcagggtttttcccggagaatcagagagtgttatctcccccgccatcttctccgcgagtcgatgacgaagtcccgattccatgccagtacactatgatggagagtggttatataattaacgaagatcagttcgacaaagagcgataatagatgaattattaggtttcctcatatgctctctttctcttcattaaattctctttctgcttctcaagcatcttcgctgcctcctcttcagaaacatcaggatcgcggaatctgaagtatttttcacagggcatctcattacaaaatccgcaatgtgcgaactttttttcatttgcacaacattcatgaaccgggcagacatcagtgtctgcaaattctgtccagaagacgctcccgtctgactcatcacatcccggacagtctctctcaaaatgatcacactcatcacagtacatcccacagacagtaggtatctccctggtcatgtatgatgtctctgtttttcctggtaatgaagagtaggttcagaataaaaacgattcgtataatgatttatttcgacaaatgcatgaaatgattccaaaccagggacctgaaaaaatttattttttggtacatctatatacgattttgtctggtatccagacaagaggagatgtacatggcaatcatcaaacgtgatccgttccacatgttcaggggtgaactggataatatgtttgccgagatggaaaacagatttcagtcactccttccctcttatcctgcatattcacagagagggcgtgaactttctcctgttttctccggtggattcaccgtggatgtaaaacaacaggatgatcaggttattgcaaaagctgatcttccgggttgtaataaagaggatgttaaaatccgcctggtcagaccaaacctccttcagatctcctgtcaacggaccgatgagaaagaacaggaagataaggacttttttattcgggagcggttctatggttcggtcagccggagtgttcccctccctgttgaggttttagaagaaggagcacaggccaagtttgaaaacggggtattagaggttattttcaaacgggcagagaaagagagtggcggggatatcccgattcaataatttttttcacggatggatataagtaaacccggttaccggctggattgatattgtcacgttctcaattgtataattcagggcatgcccgccggatgtgttatcagcggatataaagtgttgatggaaaccggccacatttacacctgccatccagtccgggaaccagaacccggtcaatgtcccgataaccgggccaaggtcaaagactgattgattttgaattacttctgataatggcgggtaaggaggactctgtgagggaacactgcgtgcctgcatatctgcaaaatctccggtaactttcacggcatagatagtatcatcatcagggaataagtcggtgatgactgtatagacctctgctttatccagggtttcattcacctggtgagtgatggttgggttgaagtggatgatgtttgcaaaacagacttttgtgtcatctgatggctcatatactactccgtcgtgggttatctgccaaaccgtcccgtcaagcatgagtagttctccatccatgtgttcataccctccgatcccgaatgttccgttatttttaaggtcaccaaccgttacgactccgtcatactgaccgtcagctaggagtgagtacgctgatacatggaagaggttcgaggatggagtatcattaattactgctgatccagggaccatgaaaaagagagctatacaaagtatgactgctacctgatggggatgtaccatactaagtaccttatcactcgggatacttctctttttttaacacttattccgatgatgtatctataaatgtaacacccggagcagtcacctcatgtgcaaaaatgtcaatcctggtaatatccaggccagactccaatgtctgggatattgaaaaatgacaccttttttatttcaatactaccgatgaaccccttatggtaaaaatgtcgatgaggaccagaatgagaagattagaggctcaattcttaaatagtatccctctgatcactcaacttactttttttatgcttcacctacattcgttccagaagaggatgtgcgttgtttatgacatgatccccggtaatggttgtcgtatcggcaaggataactactcctgactgcaggtcagagtttaaagcaatagctgcctggtgtgcgttggtttctcctgatttagagaggatgatggtcccgtcacggttatagagaatatcccagaataatccttgtttcataagtggcggtccttctgtaatgattgcatacggtttgtaagtcatcacaattgcgtcagataacgatgtgtcaataaagccaagttcagcagcgagaagtatcgccatatcatctgcgtttgaatggaatccgccggttgcagtccagaagtcattgaacctgatgagaattgcttcatcggttggatactcataacccggtcattaccttagaaatcgacccaatatcaaaaatttttccattaccggggatgtttcccgccctcgtccgtaggtttccatatgtatatgtggtatactcccttttttgctcagtaccagttttgtcaccaggtatatgaatcttaaatagcagggtgaaagtgaaaagtgaattttttattgaaaatatgcgtatttatgtgtataatgggcattattttcaaaaatctctgcacctgttacgtgaagacaatccggtggataatgacgataccaattagccagacaagatatgctccagcaattcccataaaaaaagaaacgtgttccaagaggatatagagggagaggataaatacaagggttggaattgcaaaatagaatgatcccagggttaattctctggttacgtcctgaccagattcaaaggtggtaaagagaaatgcgatggtggtagtaattggtgctgcagcaagtatccccccatattttgggtccatatgctggactatcagagtcactccgactatgatgaacccggcggttaggaatttgatgatggtatacagataatccatggtactggtaccatgtgaatacatagtatataaggagaaaaaccgggattgacatcacatcaccagaaccccacctcataccaatacatgcgcaaacagataataatgggaaaaaacgtacctgatccggttcatggatgaactttttgtcttcggagcggcatttttagccggactgatcaatgcactcgcagggggaggcactctcgtgagttttccggcgttgcttgctttaggtattcccccggttacagcaaacattaccaataccctgtcgctctgccctggatattgtggcgggatgattgcccagcggaaagaatttgcctttcagaagagcagaattcatcagatccttccaatctgtattgcaggtggtcttattggcggttttctcctcatccattctgatgaatcatcgtttcggacactcataccatatcttattctcttcgctacagttctgcttgcagtgcaggatcggacaaaaaattttttgatacatggttcatatcacatagaccacccccggctcgtgtccggcgggggattccttctcttgtttcttgcggcattatatggggggtattttggtgccggagtaagtgttatcatcattgccgtcctgggtctcctttatgacgactcgcttgtcagtctgaatattctcaaacttatcatttcattcagtgtgaacctggtggcttcactctacttcatcttcaccggcagtattttgtgggcacttgtggttatcatgagtattgggtcagttttcggcggtctagtcggaggcacgtttgttgaaatggttcatcctgaaattttcagatggataattgtcggtctaggcctgtgtatttctctttggtattttatatgtgggtaaatttctactcaatcatgcctgactctcatcatcagaggatatatctatagctctgcaccagactgtatatagaagggatcagatgactgatgcattgaaaatcctcgttgttgatgatcatcctgacatttgtctggcagtacaggcaatactggaggaagaatcctggactgtccttacggcaaatggcggggaggagtgtataaaaatattggaggatggtttctccggattgattctccttgatatcatgatgcctgacatggacggatgggaaacaatacgagagattgagtcacgtgacttgtaccataagatcatcatctgtatgcttactgctaaggataacccggatgaaggaatgattggcattgaaaagtatgtgtctgattacattaccaagccaattgtccccgaacttctggtagaacttgttgcgatgtggatgcaaaatattcctgaaacctgaaaaagatcatttaattttatgatcccctccctctttgcgctatccttctcatcagatccaatcttccagtcaaaattgcattcatatctggagcatgaagggattcatgtcgatactctcctcatgagaagcgaagccctgaaaaatattccatttcatcggtatgatgtgctcatcgtaaatacggagagtagtgaccgatgtgatgatgggtttgatgaaatccgaagaaataatccagatattattataattacattttcatctgataatgtcgtggtagaaaaaaatccagggaattttaagaattcctggtattttcatattaaaacagataaaaaccagcttctttttgaagatcttattcacaccatctaccatggtgttattcagcggggatttatgcacctgcagggagaggtatctgatctattttctctcgtacaaggcatttctgacccattttttataatggacaataaaagggaggttcacatctggaataaagggatggtgaatctgacggggtattctgcttttcagattctcggcaaagaccaaaatgtgcattcacttccgtttttcaaaaattatgaaccaattctgatagacttattggtggattatcataatgccgtcaggaatcagtatgaacctctcatctccatcggaaatatttgggtcatcaatgattattttccgcatcttaacgatggaaagggcgctcatctccggctgtatgcttcaccattgtatgatcagtcgggagggttgcgtggagcgattatgtctgcacaagatatttcattcgttatcggctttcctgggtattcgtctggagcccctcatcacagatccccgcttcaaaaagagattactccctgtaattattcaaatatgattataaatggttttgttcggaaaaatattgagaagaagacgttatcacccgtatatgatctgtcagagaacaataatgacagaatcaattcattcgatgatacagaaatatctgattttatattctttttttaccggtttgtggagactgcacatattcctatcattggctgggatgcatcatatgcaataacgctctttaatcttggtgctgccagacttaccggaatttcttctgataaagtactcggccagaaaatctttacgttgtttcctgacagtcagagagatcgatcactgagcctgattcagcaggtccatggacctgaaccggctcttctcagtgccatgattcccatagtccagaaatcaggagatattcggtctgttgtatggaattttgagcgttttaacggaccagacggggggccattattaatcattgggattggacaggatatcaccgaacaagtctgggcggtcgaatatctgaaaaaatatatttcagaactgactgagaagaatgatgagttaaaccgggtgaaaagccagctctctgaaattaataagcatctggatgatattgttgaaaaacggacgaaagagattgaagatctattaaaacagaaggatgagttcatcacccagataggtcatgatctgaaaacttccctgactccggtaattgcaattcttccggtattaagaagaaaagagagtgacccaaaaaagattcaatatcttgatatggcgattcggaatgctgcacaaatgcatgatctgctgatcagtattcttcagatggctcgtctgaataaatcatatctccccggtatcgggacctctcttccgattcgtgagatgattcatgagttgactgtaaatttcgaatatgagatattaaaaaaacgtctgatcatcacgaatgatattcctgcggatcttgaaatcagaatgagcccgatcgattttgatactatctttggaaatctcctggataatgcgataaaattttcaaataccggggggagtattacttttcagggagaacgaactgaaaagggaattattatcacaatcagggaccatggtattgggctgcttcctggagaagaagaacacatcttcgaaaaattctataaagctgacagttcacgacatgatggaaaatcatacgggcttggtctttcgattacccagaagatcgttgaacggaacggaggaataattcaggtaaaaagcgatggacggaataccgggacgacatttaccctgatattccctcgtttaaaaaccctccactcataaataattgactcattgtatcatttttagaatactagcagatagttacacaatatatggtttggataaaaaggacattttttctaattttcaaaaaatcagtcttcttaaaatagcataaaggacaataggtaacaccaaaacattactgagaaatatggtccgggtcctaattgttgaacgtgttccatttatgcgaaatattactcgttttgcgcttgaatgtagtggtcacgaagtaattggtgaggcagttgacggtcagcaggcccttgatttatactatctttacacaccagatctcgtaattttagctcttgtcctgcaaaaggtacagggtattcaggtattacgtcgaataaaagagacacatcccgattcaaagatagtcatctgttctgctataaaaacacagcgaatgatcgatcaggcgatggaatatggggctgactcatatgtaattaaaccttttcagatctataattttatctctgaagtgaaccgggtaatgggaataaaaaccacacctcaggggctggctcaggaacaactcctctcacaacgtgaagaacttgagcagatagctgcaaaagtacttacaaggacgatatccagagaggaactccagagttttattcagaaagttcagggttcctcgcatcagtgataatggaaaatccatcttttttggtcagaattcatcaggatcgaatctgaagaaatgagaaagatctgactgatgaaaatggtgttgtaatctgtgctgaaaagatcatggccactgataatggcggggtttcttttattatctctttcataatcctgctgcagacaatacaccagaattcaagatctcatatgaaaaacccgcatcttccagccttgtggtcggaaccggtatctatctccctgatgtttcggtttcttttgcagaggagaagcgggaaaaaatgaaaaaatggatggagaagctgttcactatgtttatgagcaggggagggatgcgggcattcgtgaattcaatgatccgagcgggaccttttcagatccagagatgttcatctttgcctttgatatgaatgggacactccttgcaaatccgtatttcccaggtctggtcggacaaaaccgcctgaatgatcgcgatccgtacgggaaatacccggtgcagatcttatggccaatggagaacaaggcgttggatatacctactatttctttgccgatccggattctgactatgaaatccgtctgaaacttggatataccgaaaagacagaggaagaattgatcattggtgcaggcatatttcctaaatcctgatgaattattattcacattttaagtgtatcaaaaaatggatggagaggtctcaataccccagttgtgcaggtatctctcttgcttttttctcttcaccctttggaaccggaacagttatggtaaaaggatcataaatctttgccccggtgatctggtagaatctgaagagaagggcaggttcatccccttcctggtatgatacgccggtaaaaccatataaaaatccggaatatgggtatactgcaccttcatagatgagccctttcgtactaatccatgcctctgccggcattttagcttttctatctctgaaaaacccgggagtaattttcgcaacgacaaacataaatgccgctatccccagaagaacaaagccggtctctactcccccttccggtacaaaaagtatgaaaaagagggcaaacaacagaaacataccatctataataaccaggagggctgcattcctctctttatgctcctcatattcacgtttcagaatacggtcataccaggcaggatcataggtccagtgtgccaggagattcgcatcggtcaccacggcatcaaatgcccgggacatcggatagaatatgaggcctgcgacagccagcgaggagaaaaacaggaagatactcagaaacatcagggcacacccgccatcaaagcagggaatgacggtgagtccgacaagaaataggaagatagaaaatccggcgaataaaaagcactgtattatccgttttttactgatgttttccatgtctggtgatgaaaaattggagatgtgagtatttatgaatttaccttaccgggaccagtcggggtgcatgaaagaacaggaaatcaacatgtactccgttttaatggataatatagccattctccttatgtgtgaatgaattgaagctcttattaactgtgtttcatgtagaaatggggaacatgatgcccttactgatataaatacttctattacacttgaattgaaagatatcggacggatggatgccttgtcatcgaatcaccggatcctgtctccaagagcatggatacgaaggcccttatcaccggatatctcccttatgaagccgactggccccccgacgtgcgggttattgccgatactccttcgcaacagacatcaaaagggcagaccatcaggcctattccatacgatggtgactcctctgactgacttaaaaacaggtttaaagggtgaatcatgagagtaataaaaactttacaggttgcatagcagatcatattttttatggggtatctttcagagtatgtataaacgaggtatgcatatgcaggatgtgaagatttctggaagaacaggttttataattgtgttccttctcctctcctcatacggagtctgtgcagcagaatcaggagatctattgggtggatccggatacgcatatctggttcaggaagatccctattttacctttgggtaccctgccggtatgacgcttcaggtaactgctgaagatggacgaaacacatatcatcttcagacaaaaaaagacccgccggttacgttcgtggtgacctcaatggagaaccctgaatggcttgtcttaccgacagaaacgctgctgaactatgaagagtcagcacgaatgaaatttatcgtcaatgaatcgcacaatctcacctgggggaaggatcaatacagccaggatgagaaccgctcaacctgctttcggtcatatcttgatgaagacatgggagaacttgtcttttcttccatcatgagtacacaggacgatgtcatctatgcccttctccgcgagcctgttgggttatatcagacagaatatgggaatttcactctgaaatctcttttaagtgtcaggccacgggacccacaccagagttataatttcactccggttgatctggatgctgatccaagtgtttttctaaacgcgataaattcttcatcagggacgaaggattttgcgtatgatccgtataccggtctctatagggatactgataccgggtattattatatcccgaatctgggagtttttttcgatcccacgacgaataaattctattatccgtcagaatttggaaattatagtgaaaactttttccagaactatgaagggcagtatattccgtcagggacgcttggcgggtattatgatggcctgtatgcaggatatgatgcatctgatatcattcatgatacgtatcagaaccgtcagaacgtatatgatgcggcaaatgccatgtggcgcgattatattcgtgacgaccagtactatggggtggatgactccggatatgcagagcctatcgataccgttcaggaataccaggattatgggttatcctaatcacttttttggatctttgacctgcgaaaaaagggagtagtataagagatccagagttcaggctatcttttctgcagccatttcaatatcttcttctttgagagtttttcttcccgcgtgtgcggcaagtttgactgcctcttttaccagttttcctaagtactcttcagtctttgccacaagaatctctgatgcatcgcttccgacacgctcagcaccactgctctttgcaacccgtacaactgctgcaatcggtaagtctgccatagtttttacctggatataaatattgtagcactcatataaaaaaaattgcatcgaaaagccatttcagcccaggaaccgtgatgaaaccgtggtctttggttccctgactcatatgtcagatcactttcaccctgtttacctgaacttcttatagttgtgaaaataagggcataagaataagatatgaacaagaagtttataagtattccaaatgattctttcacgattctggttggattcagtgattttctgagtagaatgctcgccgatgttccagtgaaattcaggcagggcaccattgtgtacattcactccggcggtggaaacctgtacctgcaatcgtctgccggtgacaagagccggattgtattcaggcaggagcgcaatatcatcgatataatcacgatgcttgagagtgaccccgccagatttatcatccttgcgtatgatcctgcatggtttcgtcataatgaggagtatatcggaccatttggctatgtgtgccggaaacgttccgggaaccgtcaggaggttctcctaatttcagaaacatttgattcaaccatctcggaccttgaatcaattgctgacaagctggtctgcgttcaggaacgtctcacctggtcatatcgtggttccggcgatccattccaatgtgtacatgacagttcccctgcgggaagtatttcaaatacggaggtgaaaaagagcgggcaacaatgcctgatatggtgattcggctatctgcttttgagggtatttcgtgaattctgggaaatgaaatccaaacttttttctattttattgtattacattacctaaggtgggggtatgaaggtaaaggatgttcttctggaacaaaaaaaagaactgattcttcggcttcaaagtcaatacataccccgttctgtagaaattaaaaatccagatagcaatttgattaaaattatcattggtccccgaagagcgggaaagtcattttttgtaatgagatacctgcttgataccgttccttttgggtatgtgaattttgacgatgaacaacttactgatctggaaaaaattcctgatattctgacggctatcaatgatatttatgcaggctcgagaacaatcctgatggatgagatacagaatatttccggttgggaacttcttgtgaaccgtctggcccgtcaggggtataatctatttattaccggaagtaatgctcatctcctcagtaaagagcttgcaacgcacctgaccggaagacattcggtcacaacaatatttccgttttcatttcaagaatttctgcaaatgaaaaataaagacctgacagaggcagaatatcgtgaatccctggaggagtattcccttacggggggttttccagaacctcttttagcctttattgacaaaaaagattatctcatccgcctttttgatgcgataatctacaaagatattatcagaagatacaatatcggctatcctcagggtttgggtgaccttgcccattatctgtgtagtacaatctcgaatgaatactctgttcacagccttacaaaaatttccgggtgtaaaagtgataagacagtaaaaaaatatctggattatctggaacagacgttcttatttttttctgtaccccggttctcctttaaatttaaagaacaggtttcttctcataagaaaatttactgcattgataatggttttattacagcgaaagggttttcctcctcgagaaatagtggacgacttctggagaatattgttgcagtctcactcaagaaagatgagttatccggcctgattaatttttattattggaaaaatgctcaacaggaagagatagattttgtagtccgtgtatatcacaaaattatcgctcttgttcaggtatgtacaaaaatggatgatacaaacacgaaagaaagagaggtacgtgcccttctaaagggagcacatgatctaaaatgctccaaccttgtcatgttgaccatgtatgaagagggtgaacaacaggaggagtggtttggctattctggtgttatcagatatattcctctatggaaatggttattgttaccggctcatgagaaactcggatactctctttcctcataaccaccaacaatacctgagatcatggatttgattttcacctctgttctcatcggtatcggccttgcaatggactgtcttgctgtttcctttgcggttggtgcacatcagaagacgtcccggatacgagcggctttcatcctggcacttttctttgggggatttcagggtggcatgactctgcttgggtggctcctcggctctggatttgctgatgccattgctgcgtatgatcactgggttgcagccgggcttcttttcatcatcggcggtaaaatggtccttgacgggattaaagacgggcatgaagaagaagcgccggatgtttttaactttgttgcagtattcattcttgcagtggcaaccagtattgatgctcttgcggtcggtctgagtttttcactgctgcatattgtcccgctcattccggcactcatcatcggtctgatatctgcgattttctctgtcggcggtgtatattccgggggaaagataggacatatacttggaaagcgggttgatattcttggaggtgttattctgactcttatcgggatcagaatcctccttgaacacctggtctggaacggggccggagcataacccatccattctgactacagatatccggagaggatttggataataactcctgaaaacccgataatgagaccgattccagccagagggagggtataattattaataacaccggttgtttcatctccggtgaatcgtttcaccagccagaagtagggatcgcttacaaacgacaccatacatgatcccccggcgatcatcaggaccagggctgccggctgaatatcaggaaaatctgaagcttttgccaggatctctgccgttgttgcagccgatacaacccgtgatccggacgctgcctggagcgctgcagcaagaataaaaggaaggaaaagtgcaggaatagatccggatacgaaccaatagatctcctgtgggaaggatccggcggcgataaccgctccaaatgctccggcaccacagagatcaaacatgatcagcccggcatattttgtcccgtcatgaataccgatatcccgtgcctctttcccgactgataccatggccacaagcagaccacaaaagagggctatggagattatggaaaagaatgagatggctggaatcagaagtccgagtcctgccaggagaaaaggggttatcaccggagcccatgctttcacccgtgagtgcttttttagtgggattcttacctctgattcaagaccccctgtcttttttcgtgcatacaaaagcagcaatacaagcataatcacggcaacaggaataaggaccagatccagagcccagggatctgcaagagagggcaacagggtcaccatgaccgggaccactgccggagaagggtatatgagaacaaaggatattatcgaagcaattgctgcaatatacaagtatggtgacgctgattttttaccgactgtctgctcaatgaccggcgcgatgagaacaaaggcagtattacagcacatgagcggaagagacaggatccatccccctatccctgccgtattctccgggcttttcatgaatcgggagatatcatccacaatggtgtcgatgtaccctgaccgcctgagcatatgggcgatacagactccacaaaagaccatgatcgcaagaacctgaaatattttcgcagcccctgatacgatccccagatacaaaacaaccgggtcattcccatcaaggattccatagatgaatgctgcagagataagggtaataaatggagagatcctgaatctgacagtcagaatgagaatatatacaaggattcctccaaagatgagaattgagttcattcgagccggttgatagaggcatgtgttctagaagtcctggcctggttattaccttggatcaggatatcttttttatccggaacactccccgggggatggatatcaaaaaccgggctccctttcccggttctccattttcacagattttcatatcggtaattgacaaaatctcccgcaccagaaacagtccgattcctccaacaagcccagttctccgctcaaatattttttctttccgatcagattcgaccccaatcccgttgtcctcaaggatcagggatacttcgttttcagaggctttaaaataaaactgatacttggttgcatgaacgctgtgatatttgatattttccagcaggtaaaaaaatgcatcttcaagtaatggatctgcgaaaatttccagtccttcaagcgtaatgcttcgttcatactccgacatgtcaagatgagaaacggcaaaaacatagacttccatgacattctgccattttggcggatgaatacccatgttcaggtactgctttgccaggtgtaaaatccgctcaattttctgcatctgggagagggatttctcaagatacatctggaccggctcatcggatactgcttcttttgtcagggtcagatacccgcttaaagagaaaagagcgttttggatatcctgaaaggtgagggagtttaaaaggtttaattttttccttgcaagatcaagagcagactggatatttctcagttcatcataattctctctcagttcctcttccttctgctgtatctcttcaatagcatcaaggaggtctgcattggtctgctcaagctcatgaagacgctgctgaagttcgggatagtaacttttccgaatcgacgactcgccaaggccgatgatcttcatccgctggtcatcccagtcgggtgattcttcagagtgctccttcatatatgtgttccaggtcgcttacagtcggttttcgtggatttgtcgccagacagggatcccgaatggcggattttgcaaggtctgcaatatcctctcttgatactccaagatctccaagccgttctgtaatacctagctcagttctcagtgcctgaagagctgataatagcttctgttttatctcctgtggatcatgggatgagcagtcaacattcatcgtctgcgcaatggtttcgtaccgttcaggacagacctcaaagttgtaatctatgaccgattcaaggagcagggcattgcattctccatggggaagatcagagagtccgcccaggctgtgtgccatggcatggactgcaccaaggcttgcattagagaacgcaagtccggcaagcaggctgccaagcattgttttataccggtacccgatatggtcaggattatgatatgcaaggggcaggtatgcactgatgagacggatcgattcaagagcctgaatgtctgtaaccggtgaagatgcatttgaaacatatgcctcgatgctgtgaaccagggcatccatcccggtatgtgccgtcagatccgaggtgagagacgtgagggggaccggatcacatagtgagatatcgggaacgatttttttactgatgattgcgatctttacttttcttttggtatcattgataattgcaaactgtgagacatcagcagcagatccggatgttgtcggtatgcagataaggggaggggccgggatactgacattgtccactccttcaaattcaaggatgtgttgttcattggatacgacaatcccgatacccttggcacaatcaatcggacttcccccgcccactgcaataacggcatcacatcctttctttttatagagttctgccccgttcatgacctcataatcacgagggttcggggagacatcagggaagattgtatattgtattccctcactctcaaggctttctgttacatcaccgacccagccggctttgatgagttttggtccggtaacgagaaatacatgatttgcaccaaaattctttgcataccgtcctgccagtctgcgggcatcaacaccaatgatgaattcaggagctacaaattttctcagttcaaataaggtatctgttatgttcctcccccccccctgtacttttttcctagtagcagtaatgcacatgcagctatttatagtccactgtactggttttctctgctcaatggtatcttaacctttctgaaacagatgcctccatcaatccgtaggcaaatttctagtagtcccggttaacggagatcagggattcaagttctcacagcacgtgcacattcccggggtcagggtacctggatggtgcgatatctgaatcatggaatttgtcttccggatcttctgatggtttctccacgaaagcttctcttcatatggaaagttaaagacttccacagatcggtattgataaggtgactgacacgatgggacaggaaatggtgttcatactttttcgatatgactgcccaaattctgtatctgaaaaaaccagaatcatcatgtatgagaacaatatcgaatcatagagatatttgcggattagaagccaaaccgggattgatcgattaacatctttgtctctcctcaaaacccttatagcagtaaattttatgtttagaaattcctcaattgacttcctgatccggattattctccaccgagttatggtcttttcaatctcttccatacgaatgggaaccatgtttaggacttttattatcgatggatttctgcccaaaagactctttttggaggaatgccatattctggtttttcgataattacgcgatctttacaaccaatgtcgggcacatacgtgactcctttgttctcaatgcggggtaataaccaagggtgttttccataaaaaaatccattgcgacaaaagaaaacttgatcttggcttcaatcacctgacagattaattcatataccaactcggctttggttttaaaacattgaaactctgggggaatgccagcagcatcacaacggctggggttttttgtccggataccaggaagatactgacggaagtcaggcaataaccgaaaaccattcgtgacataggccataaagacatcagcctgatagttctcaaccgtactcgaattcccacaatattggctattaacaccaatggagtaattcccagcctttgggtttccacattcatcgataactaatgcaccgttttttcctataagacgccatccattcgtgataatccaatctatgagccgtcggtgatcccaaggagattgagagaggaaatgattgaatgattgattatttaccgagctgaaattgtccgaaattactgatatatgacatcttgatgggttttctaaaagccctttatcatattccagggcgattgcccatccgttaaggttttttgcagaaaacagtttttagggctttaattctaataaatgcacaattaaggcaatatgagttactatggtcttgctgagagtttcagtctcgttttctcatcgtgattttgcacagtcaaaatattgtccctttatatataaagatcaatcgatataattttggatatgagcctttcaaacttgacattttagcgattttcggacatttcaggagaagatggacagagagaagttacaaaagaacgctgaatctgatatgccgggataatgtgaatggactgtggatggatgagaacggagagccgggcgaacgtgcatggtttgagattcgggtaacttacggaagatggagacggactattacaccttaatatgtaatcagatccatataagaggcatttcacctgttcaggcgtaactccattcatgaggaataatgatctttgaattagaaagactcgtgcagctgtgtgacggtgttgcagtactctctcttattgcatattttctcaccagaaccaggtattcatcggtttttgtatcaaagacattctctcctttttccgctcttttcatggccctgattggaggttttttttatctgtatgggatgatgactggtgttcagattggaccctatgatatcagtatccagatgctcggaccggtgattgcagggcttgttgccgggacgatcagtggtctactcgccggatcgcttggaatcctgttacatatcggactcggagaacccatcgggccatttactctcatcataacatttctctcgggaataatgggcgggttgttctggtacctgcacaaagatgccataatccggatgtcacatgcctttctcctgggatttttggtggcatcagttcagtttattattggaaaagatgggattaatcaggatattctgctacccggtgaggttatcgaagggactattgacattttcctccccacaatcctcggattatgcatctttgtctttatcattaacaatctccggctggaagaagaaaataaccggaaatcttttcagattgagggggagcttacagcagcccgtcagatccagatcggctctctccctgaacagaaccaggaatgggatcatgtatccctttcagcatcccttcttcccgcttcatacatcggaggtgacctgtatgattacctgaaactcgatgatgaggatctgtattttgcattaggtgatgtatctggaaaaggtgtccctgcagctcttctgatgtcatccacccggatgatactcagatcaaaaatccgtgaaacacgtgatccctgtgccctcgttcgtgagattaatcgttcatttctggaagatggtgacagcagacagttcatcaccctgattgttggaatagtacatctacagacaggtgaggtctgttattgtaatgccggccatcctccgccatatctgataacccgttcagcaacaatcgaacttgaatcagacgggaatctcccggctggagttttggaagatgaacaatacatcccgcatttcgtctcactaaaacagggtgatctgcttgtactcgtcagtgatggcgttactgaggcagaacgaggtgaggaattgtatggatcagaacgggtagtccggattttatcagagcaatctccgaaaacacccctggaggttgtcgatttactcaatcatgaagtgaaaacctggactggtgacaatccccagagtgatgactgcacaatacttgcgttacggtattattccgcctctccttcggaaaattaatgtatatggtattccgggtgtttatgcttgcccacactcctgtatcgctattcccggggggttttactctctcatgagcactcatacgaatactattgcattattacctccaataattactgataaccatgaacgagcagtatggaaaacctttgaaaataccccgaacgatgagtacccagcacccggataatgtccatactccgtttttcactgagaatattgagctcaccggtgaagatgaggtaaaggaagcgtattacgtgtattcacacctgggatgcactgagcagatgtgggactgtgaagggaaagaagttgataattacgttgtgaagaaactactttcccggtatggcgattattttaaagagcatcatctgggccgtgatctcttcctcacgcttcgggtaccaaacccggagatagaacggacagaagcgaagatcctactggaaacactggggtcaattccccggtcctatgatgttgcacatcatttctataacgacacctatgccccgatctttgagattatcctcccgatgacaacttcatttgcatcaattgacaacatctaccagtactattgtgactttgtcatcggtcagcaatataaacggttaggtggccgtgatcttacgattgcagagtggattgggccgttccatccagacaagatccgtgtcattccgctctttgaggataaggatggtatgcttgccgctgatacgatcctccggcggtattttcaggataaggatcttgattaccagcgggtgttccttgcacgatctgatccggcggtgaattatggacagattggggcagtactcctgaataaaattgccctctggcgtcttcaccttctgtcggaagataccgggattcccgtctatccgatcatcggggcaggatcagccccttttagagggaatttacggccggataccgttcgaagggtgactgatgagtatgctggggcgtatacctttactatccagtcggcatttaagtacgataccaatctggaagaagcggtgtctgcaatccggtatcttgaggaacgggagatcactcctgcacgggagattgatgatacgtatgcgatatcactcatcgagcgatatgctgccgggtatcagaaacagatacggtcattggctcctcttattaatcgtgtggcggcatatattccaagccgacggaaacgaaagctccatgtgggcttattcgggtattcccggaacatgggtggtgtttcacttccccgtgcgattaccgtgaccgctgcattgtattcaatcgggatacctccggaggtcctgggattatctgcactgactgagaacgatcgggagtttgtccttgagaattaccggtatgtgactgaagatctcagtgatgcatgccgatatctcaatcctgactcttcatttctgccggatgagatcaagaagatcctccctgactggattgagattgatccccattctgagcatagagtcctctctggtcagatagagaaggccgtgactgcctgtcagatagatagtgtacaggatatgatcatcagggctggagcaatccgaaagtttctcgggtaaaccccgttccttttctcttacatccgcgattcaaggttgattttttaccttatgtggtaaaattggagatttattggttttttagctccagatcacgggcttcaccagagccctgctattgtcagatcggaaatcagccaatacattgtgtgggtgggtttgactgatgaatagcgaggcgctataagagtgtattttagggatattttctgaatcaaaagttaatttagaacttattttgatacgaggattacggggagtgcctggtacatcagttctctcttatttctcaaaaataccttcacattgttgatatttttttcggggattggtctatatccacacatcaatatatataattgtattataggtggacacattctctatggttaattttcaaataaagacttctcaatacggaatatccgaaagatcatgcacttcatatcctgctttgcgaatttcatccttccctgatattttttttccaaccagagcacagatggtctttcggttctcattcctccaccatatgttccggctcttttcttctagttttttgagtatgctcatcgcctcattcttggataaatctgtccatttacattctacacagatcatcaggtcttcatcttcacagatgctcacgaggtctatctccatctcattatgccaccatcttcccagctggtttatgtggatgtgtggaaaaaggactctttccctgatgagatgttctgtcagaagttcaaaaagtgctccggaatagagagaaaaattcttctggacccttgtgagcacctctggcgtctgccgagcttcaatagccgtcatctccggatagatgaatctgaaccagaaggagagatagggatctgaaatccggtatcgtcgtttcctggatcccggagaagcagtaactggcagttcttcatgcacaatatgaagtttcatcagaacagaaagatattttgagaccatactccggtcaagacctgtctgctgaatgatctcaccaagtgaggtatttcgctcagctattgccttcagaattgtcagataatttgcaggttctctgaattcatactggagtaataattcagcctccatcgtgaggtaagcacctttggtaagaaagagtctggtaatattagaccagaagtcagtggtgggatcaaagagttcaagatatgcaggaatccctccggttgtaaaccatacctgagccagatcaacacatgaccagggaaggaattctttcatatgaagaaaagacaatggttccacctgccattgacctgttcttctcccatacagggggcttttatatccaaggacctcctgttccataatgctgatacttgaaccggagaggacgagcatcaccggattatcccgcatatgcaggtcccagattcgctggaattgggatggaactgatcggtctctctcgataagatatggaaattcatcaataacgataggaattttctgttgtatcctgacaattttctgaacctgatggtgtgataggaaactggtccagagtgcttcgaatgacggatacgatacacgtgcaaaattgggatcattcaggaaatcagatatttcttgtgcaaagatcccgatattggtcttttcagattctgttgttgccagaatgtaaatcccttgtttatcctttaaaaaccgaattagcagttcagtcttcccaacccgacgcctgccatagagtatgataagttcagacttgtgtgagcgataccggtcttcaagaaatgcgagttcatgagtgcggttgatgaagttaatgtgagacataagtatattacttatctctcacgaaatgatgaatatatggatcacatctcttcctattcagggtattatgggtctgtatttgaaattttctgactccggtttatattttcacttttctgaatacatggatcgcaagagtgacaacaccgatacaaagcagggataatacactgatctgggtcactggaatctcaccggtctggagtattcggatgccatcgattgcaaaactgagtggattcactctggcgatgggttccagccatgcgggcatgacatcatagggcatcatagccgatgaggtaaagaagagtggcattgagatcatggcatttgctgctgcatactggtcatgatcatccagatagatggcaattgttgttgccgcagcggagaggagtgctccgaagatgaagagaataatgtacgttccgataagctgggtcagggagtataacctggctcccagaagaaatgcaaagatgagaatgattgttgactggatgactccccggatggtaatgaccagtatcttcccaaacaggatactctcccggggaggggggagggcaaggaatttattgaaaaatcccagcatacggtcaaggataagaagacctccaccggctagtgatgcagagaggacggtcatggccagaatgcccggtgttacaaaatcaatgtaatgttcagtgaaccgtatgggaagagcaagacctacgaagattagccaggcagccggcatggccattgctgcaataaacccccattttcctctaaaccaccggacaaggtcacgtttacagtacaccagtatcggattcatcgtttccccatcatattccggaaggtgcttgatttaaacggacttttatcctcccctggtcctacaagatgaagaaatacatcatcaagggacggctgcctgactgacatggataaaacctgatttccggcatcgcttagggcatctttcaccagggggagtgctgctgctccgttttcacaatgaaatatgagggtatcttcctcctgatgtgcaaagctcactcccggcacatcaataccggtgaatttccctgatatagaaactgatatgatatcctgagaaattatcccttttaatcttgccggggtatcaaccgcctgaattctgccatggtcaatgatggcaacccggtcacagtaccggtctgcttcatccatgtaatgggttgtgacaaagaccgtcatcccatcatttcgaagcgttctgatgtgctcccagatctttttcctggcagcaacatcaaggccgacggttggttcatcaagaaacaggatcttcgggttatgcaccagagcctgggcaagttcaagacgtcttctcatccctcccgaatacacctttgcccgttcatctgcccggtccaaaagatcaagaattttcagaacctcattggatcgttcaacgggatttttcacgccatagagttcggcaaacatgatgacattctccctcccactcagtctgacatcgactgccatatcctgcggaacataactaatggactcccgaacccttcgggggtttttccggatgtcatatccacagatggtcgcatctccgctgtctgggtcaagaagggttgtcagcatcagaacggttgttgtttttccggagccgttcggcccgacaagaccgaatatttcggttccgactgaaagggtcaggttatctactgccagaagatcaccaaatcctttggtgagggaatgggttaccagtgggtattcatgaacggattgattgtgacggtatgtggttgccatagggtataaggatttcagggttctttccctgtttcgtattacattatattcgagtgaaaataaaaaagcgttgaattgtattcatatcattcaccgataccgttggaagtaatcaagggtggttctgcacacactcctaatattccggattctgataccgtgatcattatgaaattattatttttatattatggctttttatcaggttcagggatgattacatacatttcatctcatgataatctgcaatatatcttctcaaactctcgtattttttttgcgattattttttgaatctgggcatcattcaattcatccgtatatttttcttcttccctgatcatatcatcgatcttctgtaactcataatgatgcaacatccagatatattcttcacgaagggttggatttttcaggaccgtatatgcaagattgacatccggtgtccgttccagtgtccggtaccgggaacgaagaagagattcaatctcactttttggaagtgagctgatatgttcatcgacaccaaagattgaaaagaatgttctatcagagggggggaggaattctttccagtcatgatttgaggataaattatttcctatccggtcaaaaatatccaatatctgctctgatactgtaagcgacatatacataactttgctgacgaattgcggatcaaaaacttcccatctttttcgcagtttttttatcagttcctttgcatcttcatttggactatcctgaatgaaattcttgcagtttatgaactgttcccgctttatcgggtcctgcattatcgctgatattaaaactgataattcatcaccggatgacgcatatgctattgcctcctcctcactgcaatcctgattcagtccagaaaattcaaaaatatctggcattccttttgagataaggaacatgtaatcgtggtgattttgagtaaaagctcctaattttcgaatagtaagagcattttttaaatactcatcatgggcttttttgagattctcgatcaaatgagccgggctatatctggtagcatgctcaaacctgataagaaattcatcatatttcacccggagttgcaggtctgaaagcaccctgtaggcctcttcgatagaatcatccggatagaccgataatgtgcactcccgttcatatgctttttgaagcgtctcttttgaaaaccctttcagtactcccagaacagcataataggatggaatacctgaactgatgtcttcaacccattgaggataccgcgacttgtaattgaaaaaccgttcaatatattgcactccttttcgtggatcgatattctccgacgagactttccagtacggatcatcgtcaggattcaatggtgggggcgattgttttgggcttttctgtatttgtgctctctttttattccccattgttcccccggatggtaataatacacccgtcttccaggtttaaatcagatatccgcaggtcatcacccggtgtcatctctccgatctcaatcatttcatctcctgtcataatctgccggtcaatcagctcacgtttcagtgattcgatagaggttgcaggattgaggtacatatccagggtcgtcttccctgactcatctccgatgacgacatgaacactcctcttcccgacaagttttttcatccacttgctcttctctttctttgaaagacgggagcgtgattcaaattttaccgtccgctcgtttcctgagtcagtgtcataggcccggacattgaggattccgaactcttcacctaccgcgaatgtgacttcaattttattttcttcggctggcataggttcgacgctgatataaaactgcccaagatattcattatcctccgccatctcctcctctccctgatatactgcgatgatgacttcaggaacataatcccatgaatttgtgtaaagccttgtccgggagattgggatttttgtgtttcgttcgattaccctggacagagttccgttcgtgatttttacaccaagagaagaagatattacatcactgatctccacattcttcgccatcctggatttttctggaacataggtacttcctgccagtgctgccccttctgcaactgcagtgtatggatctccttccagcggttcttttccaaaatattccgtaacaaaccttctgaccgctggtatcagggttgttcccccaacaaggaggatatcatcgatctcatctttttcaagggatgcatcgtgaagggcacgttccattggtgcacgggtgcgttcaatcagatcctgaatcagggattcgagtgtttgcctggtcagttccatcgtgaatggaggacggttctctgcaacaaacggaatggtaatttgtgtactctcttctgtagaaagggctatctttgcctcctcggcagcctccttgagtgtagcctgcaatgccaggtcaattttatcgctttttccgagttccttttgtaatgctttcgtgacataagcaatgatccgcgtatccaaatcgtctccgccaagccggtgttctccggtacttgcatcgacatcaaaaaagccggatgagacagaaaggatggacacatcaaatgttcccccaccaaaatcgtaaaccagaacttttcggtccctatcttccctgattccataggcaagtgcggcagcggtcggttcgtttatcagccggacaacattaattcctgcaatctctgctgcatccatgatcgcctgcctttggctgtcagaatagtttgcagggacggatacgacggcatcgtagaaggtttttcctgtccgttccctggcatcctggatgagtttttgaaagatgagggccccgatatattcagggggaaatttgaacctccccacctgtttcttataatcagttcccatttcacgcttgatggaactgacaactttatcagggtggataatctgattatgcttggcctgctccccgatggagaactccttttcgtttttgaaatatacaaccgatggggtaattttgctgccctggtcgttctcgatgaccactggttcatccagaagcatatatgccatcttggaatttgttgtgccaaagtctatgccgattatatctttgttcattgtagtgtccagtttaaaattttcattcactcaccgggctggtatggatcctggtatcgtggcatctgttcaaccagattcagcgagttattatgtaaccttatcgaaatacatctctcaaattctctgacatgggtagttaatgtgcgaagatcatctttcagtttttgcatatcatcttccagttgtccctgaatgtcagcctgttcggtaataatctgactcaaatcatgaatctcctcttcattctgttcaatcttcttctccagttctgctatctccttttcaagcctggtgatatgttcactctctttatgggccagctggtcgatatcatgagtgattgcatcaaatttctgccggtttggaaatatccggttaaagattgaagtgaccatgcctggcttttgtaatggtagaggctcccttggctttttcgagatgatgacttctgccggtctgataagttgagactcccgcaggtatccgcgtcttactactgaaaatatagtgtcttccgggtatttgctattatattcaagtccgactgccatatgcagggtatcatcaaatatggctccgggttgtgggtcgatgggtgtcagtttgcctgatgagagtacctgctgatacatcccttcaatattgagatgataattttcatggacctcccgcacggcatcacaggtgggattttttgagctgtgcatcatgcgacataacgaatctgcaataaccagtaatttttttgcttgatctgcctgaaggtctttctttttcaattcctcattttttcgtgttgtctcaatgaaatctttgaattcttttttaatggcgttatattgagattcaaaatgttctgcttttttctgaagatcggtgatatccggatcaaccattggtgacatgtttgtctttgggagaatatagcttttattatattgtcccccctcattggtacaggatgtacctggcagggaatgagtcaggtttaaaagattttgcgtctgccttatctttagataatccgcgattgctgcattcaagaccaggattcatccttctttccctgaagctgttccagcagatcaaggattagtccatattgttcagatccgattctgaaaccttcacggatcattacctggagaatcttttttactttctctttggatatgattctgtttttcacaagagtaaaaagaataaatgcagatcctctcacttcaatctgaaacatttctccgatctcacgacttatccggtcatcaactatggcgatgccttgtagttcgtccgagagagccagaacctccatctcccctgggtgaagatcacggtgcaaaccagagaatttctctaaaaaatgctcttctggcggtttcagggtaagagattcctgcgtaatgagatgagcggtaacttcagcatcaggatgtccctgtaccctcccgatcgtaacaacctctgcatataccgcaggggggatgtaattttctgaatgtacctctaaagcgagatggagagctccggcccttgcaaaatagatcagtggtgatgaatcaaatacccgaatcatatcttcattgctgcctgataatcatcctgaatatcctgaactgatacattaaggattacattgttcttcttcaggagatctatcatttctctcacagatatctcacatatctctgcggcttttccgagtgaaatacgtccctgcctgtactgatccaaagcattttttctgagttcttcatcaagacctgaggacaaggccattcgaatcagggaagagcgatctaatgcagtaagaagagacagtgcttcaatctttcgtgatatttatgaggtagggcgtattgaaatgacagaaaccatgtatacacaataaatatttatatacatgaacttttctgctcattaaatactccttaaccggaattaaacgcccatatatattcgttttattctgatgaatttgacaggatgatctccaacatgacttttaaggataggtgggggattatgacatgaatcctgtgaatcttaagagattgaaatcttaacgaaatgataattcccatgaggatgacgagaggagataatcaattcgattagaaattgggacgataatgtttaaaaaagaggtttagtcatgtccatggcagcagttctcatgaaagtgatggtgttcactatcgtggatatgctcatgggtgtgtacttttccattatgctcatgtgcatgttcatgcttatctgaatcgtgacaacacattctttttgcctccacctcatattattgaatagccatagataaggtttctgtcggtgttacgaattttaagtgtgtattaagccatatatccagaaaacatctcaaatcattgttttttgtgtggtaataaaaaaagtgttacgttttttcactgatacatatgtagcagttcatcgtttatgagtggaattttttaataggaaacttttctcgccatgagatctgatattttaaaaaaatattcttaatttgaccaccttaattttgttgcatgttctcattgaatggtctgaagtatggttgataatgaatttaagttaataatttcatcatattcaggtaagatccttttttatggaattctgtttgttacaagagggtgttgcaccaatgatcaatatcatgcaggatcacaaatgatcgatctctaccccttaagctatcaaccaaaatagactaattgatgtatgaacctgcatgtatcaattcccactttacatactgtgtttgcaaaaatataggaaaaacctgaacctcttgacggttttataatattcgtagcaaattctttaattttaactataccctcaaatctgataagtttttttatattatgcactaatgcagctaaaaagaattctccctcgcaattctctttccctttttgagagaaactcctaaacctcatattatgtttcatattaccaaaaactggttcgaccatgtattttcgttttcgatataactctctaccagtgggggatttcacacgtacttccataactcgtttacaaatttcctgagttgttgcttgtttctctctgttcataaaagattgccaaacaaacgtcccgatactttgcaattccggaaatgtgattatttctcccatacaaatcgcccgacatatcatttccattcgtgagatatacccatcattatctgaatattctggaatttttctttctttagaaggagggatgatgagttgaatgccataatccaattctgctaaagaattcgggtatgagaaataacctgcatcagatagtagtatattaggcgaaattgatggatgaatacccgtaaaaaggtcttcgagttcatttagcataggtattaataattttttatcgttttgctcatctgatatcattgcagcgaggataaattgattttcagaaacgataatctgcccattatacccttgaatccagccattggtggttgacattatctgactttcaggatcagtgagatttacttttgaatctgaagatggctcttttttaggctctaaaggctttctacctcgtttctttttacccgattctaattcttctttttcgcggtccagaatcttttcttcttgttttttagattcgatatcatgtcgttcaattaatttctctttagcccgattaagaacttcctttcgtttttcttttgttgaaagatgctcaggtagtcggttaatctccatatcctgaatatttatatcatcgttttctaactcatcaatttcctgtgattcatcaaaaagccgacctagctctgcttcaaggtattttaattttttattggctgataaagaggcattacagccaaattttgatccatcgagggctaggacaccgattcttgctatcccggattctacgataatttgagataattgtttaaaaagggatttgatttcttttgaattattcttcttgaaacgatagatcgttgtatggtcaggtgtaagattattggcgacgatccgatatccaatatcataatggcagcacatctcaatttttctgctagatttttctccacgaatcattgaataaattattattccaagcattgaacgaggatcaaaaaaggcagaaccgcgaccatcgtcacgatatttattaataaatggactaatatcgagaatcgaaagaatttctaatatgccataagtaatatcattttcagatagccagtccatcgcattgacagggagtaaaaattgttgttcattaccatatcctctaatcatgttatagcgatgagacatataatatattgatcttaataatatatataattaagctttaataatttatattaagctttttttgtgtttgtgcaacagcctcacaaatatttcataattatcgggtattggtaccacatgtatgtggtgggttttcattatcagaatgtgaatagatctccaacgcggactgtaacctgcagtgatatgtcggaaagaagagatatgttctccgtatatgggatacgttcatctgaatacagatgccttgctccagcggagataataggataccatttttgtgatgatcatgagcaatacgttcattcaggtaggtcagcatccctgcctcgtatccttctctgatccgggtatctgatgaacaacgcaagaatcggcgataatgcggttggaattatcatgagaaacatcgcatccggaagggaacccatattatcagcagcccagccgatgatcgcggctccgatacccccaacccccacacaaagacctaaggtaagacctgaagcaaaccctacggattcgggcagaagttcctgcatcatagtgaccgaggtgacataacagaaacacgcaaagaaggagtacataaagataccactatacataagccatccctgacttagaaagataagacaaaaaaagggaactgcagctgcaaagccgaacaccagcatatttttccgcccatatctgtctgaaagatatcctccggcaatctggccggcaacacctataaaaagcattattgtgacgataagtgatgtggttatagtgtccataccatgctgtccgagcattaagagagccgggaggtaggtaattattccaacataagtccaggctcgaagagaacagagaaataccacaagaccggcaggaacccaccagtatctctcctttttctgctttgatactggctttttcctctcataatgagcagatactaaagtattgaattttttatcaacagaatagatccaaactgctcccaatatcccaggaattaccagccatgcgatgctggatagcccgaagaaggttatcattactccagcgatgagtgggcctattgagtaactgatacttccacttgttgtaaagatcgagttaaatatacctctcttctctattggactgagccgatatactgattccatcgctgccgggtggaacagtgcattcccaagtgctgcacctgaaaccagggccagcataagaagatagttatttgtcaggactgcgagagatatcccggcacttgatagcagtacgcatatccatatgggtaccttttttccagtcctgtcgctgaacagccctgcaaccggctgaactaatgatgatgtcacattataggcagttaccataaatcctgccagaaaaaatgagagattcatattagtaatcaggaccggaagaatgatgggcagaaatggtgagtagagatctaccaggaaatgccccccgatactagaataaatcttctttttagattctgttaccatggatgaaatctctcaaaaaaataagggaaaaaggagattatgagatttgtgggtagatgaatatcccgtccttctttacatcaagacccggcactttcaggaaccgatctacatactcctgatggattgcataaggatcaatatcagaaagttgatccggatagagagcttttgccatgtataaggctccaagacagttgctgtgtgagacgatattcacatcaaggagatagactttgttattcttgaccgcatcaagtttatcaaatccaggtctgctctttatgcgatcaagttctgcctgggccgcattcttgtcagtatacccatatccgagtgcttcatcaaagtcttccataacaatagcttccggattcttcgctatgaccacttctggatcaatctcgaagtaggacgcagtatccatgatctttccagcggtatctttcgtattctgggtcatggtatctgctccgaggaactgtaatgtcttgattgtcggacaatcattgccaccacttccaagagctccgttctttcgtgggtacagataaatgacttttgtcttctcatcttcagataatcctgctaccttgtcatgaatgcttccgagagttcctcccatccagttgacatactcttctgcagttgatggagaaccggtcagatatccaagcatcttcgaataaccaaggctgttctgaatatcaccatggtaaatcatagccaacggagtcaggcctgattcctgtaattttttcatcagtccttcatcaaaatactgattattcacaatcaggtcaggcttgagagcaataagtgcttccatgtccggttcttctgcagaacccagattcttttgcttgctgatagttggaagaataatatcccggtttacggtattctcatcaattcctacgatcttgtccccgactccgataacctgtgcattttctgcgatcatccggtcaagagtaatgagcctttgtaccggggtctttacttttactggttgtttgaaggcatcctgtacccacatttctgtcgcagttccatcgatgatcttctgtacctgctcagcgtctgcactatctacttttccatcctgattggcatctgcaagtggagtggatgctgtttttccagcggcaatttcgttgataagatcaatatcctgctgatcaatgttcatatctgaattcgcatttccaaaaatatacagggtaaattccatccctgatgcagatcctgtagtcgtcagacaacaaagagtgaggagtgttaagagcactcctccatagatacaccattttttcatactaaatcactacctatcaatttatgttatgatcaaatttaaatatagcacaatcattcataccttatttcaaaatagtaatattgcatcccaacacatttctatgaacgatcatcagggggtatccctgaggtattgtgaggtcatgagtcaacataacccggaaaattctcaaagtaatgcttcaatgtctgaaatacaatcctcgtattatcggtatcattctcgaaaggtcctgtttcttctctccgtttcatttggaattctatttttggttgggatagcggcatcttttggatcctatgagctggatcttgtttcggtatacaccacaatatttgcaggcatttttcccgggatgggaataccagaatctgttgcgaatacgataatatgggatatccgactcccaagaatatccatggccattgtatgcggggcaagtcttggtgtagctggtgcaatactgcagggagtgcttcgaaacccgcttgctgaaccatttaccttagggatatcttcagctgccgcgatgggcgcatcccttgcaatcatcggggggcttaaattatttggagcatacagtgtggtcctcaatgcattcataagtgcatttcttgctaccatggtcatttactccattgcaaaaagtaaaggaatgaccccggaagcgataatccttgctggtattgctatcatgttccttttggatgcggttacgtcatttatgcaatacctcggaacagccgaacaggtacaggccgtggtcttctggatgatgggaagtgtatcggtagccaattgggagactgtttttattgttttttgcattgcagtcatagccatcccgtatctcatctacaaggcatcagatctcaccattataggagccggagatgaaaccgctcacagcctgggaataaatgtggagcatgtacggatgcgaacacttatatttgctgctcttctcaccgcttcagtcactgctttttgtggaatcatcggatttgtagggctggtttccccgcatatcacaaggatggctatcgggggagataaccggtatgtgattccaggatctgcccttgtcggaggaattctcctcctgggtgctgataccgttgctcgaacgatccttgcccctatgattttaccagtgggtattatgaccgcccttgtgggtgttcccttctttatgtttctttttatgcgaaagaggaaagaattatggtaaacctagaaattaacgatgtcagtttcagttatccgggtgctgatattctccacaatatcaccttttctatcggacctggagagatgaccggattaatcggaccaaatggatcagggaaaagtaccctcattaaatgcattgataccatattaaaacccaaaggctcgattctattaagcgggaaggacattctgactatgccccgggttgatctggcaaaaagtatcggactggttccgcagcatggtaccagtgcaatggactcaactgtctttgaaactgttctgatgggcagaaggcctcatgctgcctggagaatcagtgaagaggacattaacaaggttgcacatgctctcgaacgtctgggtataggggatatggcaatgagggatttttcaagtttgtccggaggacagaaacagatggtccttctggcccgggcaatatgccaggaaccggaagtgctccttcttgatgaaccaacatcagccctagatatcagacaccagctcgaagttctggaaattgtcaatcatctcgtaaaagaacggaatatgtcagcgatcattgcgttacatgacctgaatcttggtgcccggtatactgattcaatggtaatgcttcgacagggtgttatcttttctgctggaagcccggtggacctgtatactccggaaatgattgaagaggtgtatggagtaaaagcagagatcatttcagttcttggaaaacctcacgtggttccgattcgaccggtggaatacgggcattttcgtccggatgatttcaaagcagaagtcagcatggagataccggcctgaatgtctcatgcagaaaacctctgtccccgggacatcggggatgagtcactcctttatcaggttgcatcactctgtattgatttcaggtttatccgtctgatacccggcctgaagattcgggtagtccggaccttcattgctgctcttttgagctctgtagcctcgattctgttgctgttttacgtaagtattttcatttccggacttattgaggggcaatcacccggtaccatgtcacctgttatcgttgcaatgggaggtatgctcctgctccgggtcatatctgaggtctatcgggaacgttcagctcacgataccgccggtctgatgaagcgatcattgcgatcactgctctatcagaaaattctctccttaggtccagcatacacagatcagaaagattccggatcaatagcggctgtttttgtagatggaacagagcagctggagcagtatgttgcatattatataccttacatcctgctttgcatgctggtcccactctccctttttattgcatttgcattgttaatcgataccataacggcatgtattctactcgtctttgtacctctggttcctctcgcaatcatgatatcaaaccgggaaagcagagtgaaaagaaccgatgtctggcaggattacaaggcactcagttcctattataccgaaagcctgcagggattaccaaccctgaaattattcaaccagcatatttcccgtgccggtgagatacgaaaaaaggcagagcagttaagcagtacctatgtcaggcgtcttcgtattggtctgctggttagtctggtagcagatatgatcccgtatcttgggtatggtgctgccatgctctatgtctgcatacaattgagtagtggatatatgcagaccggacaggtcatgcttgttctcttactcggtccggttttttatgagcatgtcattcatctgggccagtattatcatatcagtgtgaatgcgaaaagtaccattcaatccatcctttcactcatcacaaccgacccgactatcgaagaaccagagaatacaacgataccatcccttccccgtccctggtcggtccggttttctgatgtatcttttgcatatgaaccgggccgtccggtcctgaatcactgttcgttttccatacaggagggtgaaatggttgccctggtcggcgcctccggagcaggaaaaagtacgattgttgatttactcttccggtattatgatgcagaacagggtgagatcgagatatgtggtctgccgattcgttcaattcctcttgatctgctccggagtcatctctccctggtctcacaggatacgtatttgttccatgataccgtgagaaacaaccttctctttggaaaccctgatgcgaatgatgctgatattgagaaggcagtccaaatctcccgccttgatgattttatccaatcgttgccccaggggttagatactattgccggggagcgtggattacgtttttccggaggtgagagacaacggattgcaatcgggcgggctatactcaaagatgcaccgattctgattcttgatgaacccactgcaagtgtggatgcagagagtgaacggcatatcagggatggtatccgaaccctccagtcaggacggacgatcctggtcatcgctcaccgcctgtccacgatacgggatgcaaaccggattctggtcatggaaggcggaagtattgttgagtcaggaacccatgaggaactgatacagcaccatggcagatatgcagaactggtaaaggcccaagatcttgccgggggaacagcgatttcacatcagggagggagtgtatcatgaggggaagaaccgcatttttccggctcttcaaagttattatcccacagataccgatcataagtctgggagttctcgctgatattctgaaatacggggtaacccttcttatcgggttattgggtgtcgatctgttacggatggcacgggaaggagcggatgcttcagttcttatcccctgtggggtgctcatctgtattctggcggtttccagaggagtgtttggatacttgagcccatatctctgccatatcggtgcataccggctgcttgcagatcttcgggaccagttctaccgcatcctagaaccacttgctcctgcaatactgatgcatcgccgaaccggtgatatggtttctgttgccgggaataatattgaaacgcttgaactcttctttgctcatactatcgctccgctgataactgcaatcgtcatccccatcctggtctttgtatcgctcttttctatccatccacatatcgcagtaatatatggaatcttcacgatcctgatacttactcttccaagtcttgcaatgtctttgaataacgaacggggggagtggcttcgtgtgctggttggcgatatccatgcatttctcattgacagtgtgcaggggattcgggagatccttgcattctcacgttcatcattcagatataatcaggtaatggacctgaatgatgcctaccaggaagagtacggcgtatatgttcaaaagaattcgattattaccgcgatatacattctgctcctttccggaggaataatttcactcctggcagactcgtcactcctgactgttgcaggatctatcgatccactttaccttccgattgtagtcttatttgcttcagtagggttcagctcgatggcgaatgtcattgaaatatcaaaacaactcagtctgacccttgccggggcaaaacgactctatgacctgatggacttaaagccccatgttactgaacctgaacagcctgtctgtccacacgagtttcaaccgtctatctcggttgatggtgtttcattccggtattctgatacagatgttgatgttttacaggatatctcatttgatgttcccatgggaaagaccgttgctctcgtaggcatgacaggagcagggaagacaacgattgcacatcttatcatgcgattctgggatcctgttcagggaattatccgggttggagggtatgatatccgtaccctctccctttcatatctcctgaatatggtggcgatggttacgcaggatattttcctcctcaacacttctatcatggaaaatatcaggcttggccgggctgatgcatcagacggagaagtgatggcagccgctttgtttgcccggattcatgagtttatctgttctcttccgaatggataccatacgatagtcggtgaacggggaatcagactatccggaggtgaacgacaacgaatcgccatagcacgggctgttttgaaaaatgcacccatattgatcatggatgaagcaacttccgccctagatacctgtacagaacttgagatacgagaggctatgaaggaattaagtatgggaagaacggtgctcattatcgcccaccgtctttccactatcatgcatgccgaccagattctggtcctcagggaaggaaagatagttgaacgaggaacacatgaggaattaatccgattaaaccaggtatatacctctttgatcaaggcacaggagatctgacatgatgcttttgtttgaaacatacacctggtgcaatggacgaccaaatgagggagatgtgtgagaattgggtattctgaaaaatgcgttcagcgatgtctcatcactggaatatccattatgagaaaggaaaagatgaaaagaaattgtaaatctgataaccaggatcggcattctgaaaaattaatccgaaatattagatattgtcaccgggactggccttttcttctttcattatccttaaatggaaacgaatggaattgcaggtaaaatttttaaaggaattatttaattatggtagaattactgaaagatgataatatctcattgatatcttggctcaccactgctctttttgaccggagaattttccatctggcagaagggatgagtcagagtatggcagttacaacctttgccggactaatcagttcaggaacgaatattggcatgctctttctggtaagtatgctcatcgccggggttatgaatggagatcctttgatgagccttgctccggtcatcggtggtatgatccttcttttcatgatacggggcggtgcagaagccctccgggatatttctgcacaaagaacatcggacctgatgaaactctcggttcgcacacgagtctatgaacacctgctcaggctcgggccggcatacacagaacataaaagttccggctctgttgctgcaacaatagccgacggggttgatacccttgagcaatatgtcgggttttttattccctgtctggtcctgtgttttgtcgtgccaggtattctttttgttgcattctccgttatgctggaccttccggtagcactcatccttctcgtatttgttccgcttgttcccttttcggtagccatgtcatataaactctcatggaatgaaaaactggacatctggcgggattaccatgacctgagttcatattatgcagaaagtctgcagggactgaccactctgaagatgtttggtctcagtgaccatcgtgccggattactgcataaaaaagcacaaaaattgcaggaaacatacattaaagcccttaaaatattttttggggttcattatgtctgtgatgttgttccatacctggggtatgggcttgcccttttgtatgcctgtattcagttttcatatggaaaattcggcattgaaggggtcatgaccgtactccttgtcggaccaatcttttatgaacatgtaatcgcacttagccagcatttccataacagcctgtatggaaaacgggcacttgataccctggagaaaataatggaagaagaaccagtggtatcagctccggttatcccggtttctgttcaccggacaccacctccggctgtcaggttcaatgacgtttcgttctcatatgaaacgggccgtgaggttttaaaaaatctgacatttgacgtaaaatccggtgaaactgttgccctggtcggaacttcaggagttgggaaaagtacggttatcgatcttctctaccggtttcatgatccccagaaagggagcatatatcttgatgacactccgattcattcatttccacttacccagcttcgggaacagttctccctggtatcacaggagacgtaccttttttatgatactatccggaataatctccttatcggaaatcctgcagcgggggaatctgatattattgcagcagcaaatgcagccaatattcatgattggataaccgggcttcctgaaggatatgataccataaccggtgagcggggaacccggctctcaggtggagaaaagcaacggattgcaatagcacgggcaattctgaagaattcacctgttcttctccttgatgagcccacttccagcattgatgccgggagcgagaaactaatccagaatgctttggataaactatgcaaagaccggactgttcttgtcattgctcaccggttatccacaataaaaagggcagatcggatcatggttatggatgaaggacgaattgttgagaccggaacccatgaagaactgctcaagtctggcggtcattatgcccgactggttcaggcccagctgcgaatgcttgaatctgctcctgtagggggagatattgtagggggtgcagaatgactcaagcaacaccacttcagcaattaatcaggctgagcggccttgtgaaatcccatctccgccttcttgcagcgggaatgatctgtgatgcgacaaagcaactgattacgatcgggattggtcttttgggtgtttttctcatctatactgcaaaagaacagagcaacgcttccgctcttcttccaataggaggagcgatcctgattcttgcccttgcacggggagtttgcgggtacttcgggccatatcttaatcatattgcagcatttcaggtattatcagatctccggaatcagttataccggaaagtagatccacttgctcctgctatctttatctcccggagaaccggcgatcttgtttcggtagcgattaataatatcgaaatactggaactcttttttgctcatacgctgacccagattgttgttgcagttctggtgccgttgattgttctctgtggccttttgtttattcatccgtcacttgcaggaattcttctgatattccttattatgacggctcttattccgactcttgctatcaggatgaatgaaaagaaaggagatcatctcaggctgttccttgccaacatggggagttttctcatcgacagtgtccagggtatatgggaaatccttgcatttggaagaggaaaagacaggcttgaggcaataatccgaatggttctggaataccggaaagaacaacggtcatatgtccaggtaaatgcctgtgcatcagcttcatacgcggttctcgtatccggtggtattgtcattgttcttgtggcggctactattcttactcagaatggagagatcaatccattctatcttcctattactgtcatattgtcagccggagcatttagtgctacacgggaagttgttgaggtgtcaaaacaactgagcatgaccattgccggcgcaaaacggttctttgaaatcatggatgacattccggtagttcaggaaaatggctcaccggcagtagcattgtcagcagttccagaaattgaggtatctaatgtctggttcagatatggagaatcggagccctatgttctcaaaggagtatcatttaccatcccttcaggatgcacagcagcaatagtcggccttaccggagctgggaaaacaacacttactcatcttctcatgcggttttgggatccggagaagggctctatcaggattgacggacatgatatcagggatctgaaccttaattatctcagaaatacggtttctatcgttacccaggatatctttctctttaatacctctatccgggaaaatatccgggtggggaaggcatcagctactgatcaggaagtggaacaggctgcacgatttgcccggattcacgagtttatctccggacttccggatggatacgaaacaattgtcggagaacgggggattcgtctttccggtggtgaacgtcagagggttgcaattgccagggcaattcttaaaaattctccggtccttatcatggacgaggcgaccagtaatctggataccggaactgaaatgatgatccgggataccattcgtgaactgatgaaaggaaagacggtatttatgatcgcacaccggctcagtacagtggttcatgctgatacgatcctcgtgctcaaccagggagagataattgagcagggtactcaccatgaattgttacagcatgatggattgtacgcttcacttattgcagctcaggagatataaggtatctcctctttgaattctttgattttttctggattcatcagatctcatgagatcgttcattatcttgggattgttcgtttactgattcaatggatattctttaatgggtagtaaattcttttctcttaccactatttaattaacattatgtattacgaaatacaataattacatattcatcatgcttcaggtatccaatttaaaaacttcattcagaacaccagaagggattgtaaaggctgttgattctattgatttatcccttcggaaaggagagaaagttggcctgattggtgagactggttgcggaaaaacggtatttggcatgtctgttgttcgtctgcttcctcataacacttcaatctctggaaaggtatcatataaaggaaaggatctcatgaccgttccggagagtcacatgcagaatatccgggggagtgaaatctcatttattcttcagaatccaagtgtctcattaaatccgctcatgcgagtcggcgggcagattgaggaagcagtccggaaaggaaagaatctttcagctcaggaatccaggaaagagacgttacgcctgctcaaagaagtaaactttcaggatcctgaatatatcatgaaccggtatcctcatgaactaagtggcggaatgaagcagagggtgatgatagctattggcattgcaagtgagccagatctgatcattgcagatgaaccgacaaaagcccttgataaggggaataagaaggagatactaagtctcctctcagatactgcagagagaagttccatgatcatgatcacccatgatctggctgctgcctcagagttatgtgaccggatcctcgttatgtatgccggtgagattgttgaggatggcccctgtgatgagatactctctgatcccctgcatccgtatacgatagcattcataaaggctcatccaaaaaacgggtgcaaggcaattcctggaagtagtccttcactcattgatctcccctccggatgcaggtttcacccacgatgccctgatgcctgcgccaaatgcagaacgaatcatcccgatctctcaaatggtcactcacatcacaggaagaacagatgtcattgccattaatcgaagtgaagaacctgaccaaggtatatcattccgggttatttaaaagggaagttaaagttgcagtccatgatgtctcattcacgcttcatacgggggagactcttggtcttattggtgaatccgggagtggaaagacaacaatcggaaggcttgtactcagattaatcgacccgacttcagggagaatcagctacaagggtcgggatatcacccatgtaagcaggaaggagatgcgaccactgcgaagggaaatgcagataatctttcaggatcctgaaagttcgttaaatccgaagatgcggatctatcagataattgaagaacctctcctattgtatacggagttatccccgaaagagagggatgaaaagattcgatccatggtatcctatatcgggctcactgaagagtacttaagcagatatccgtatcagctcagtggggggcagaaccagcgtattgttctggcaagaattctgattctggaacctgagtttttggtggctgatgagccgacagcatcacttgatgtatcagttcaggctcagattattgaaatattgaagcgatggaaacaggagcatactcttagcattctctttatatctcatgatgaagatctgatcaaaaccctgtgtgatcgggttattcagattcatgatggtcgtattcaggatctgcaagaccgaaacacatcctgattctgaaggtcaaaaaagggacaatctatttttttcaccaatatgataagaaacgacattcggcggtaattttttacaatatttcatacataattaaaaatattcataacttatctgatcatacaattattatggctcctgatccgtctggtatcaaagaaatgatccaatctgcatgggatgagtctgcagagcggtacgacatgcaacatgcccatggagtccagtcagaagaggagcatacagcatgggtaaacctgtttaaacagtttacctctgataccccgatcacggtccttgacattggttgtggaaccggtgagatgagtcttcttcttgcagagatggggcattcggttcatgcaatcgatctctctgagaacatgctgaagagagcagaggataaagccaggaaaaaaggctactctatttcgttttcaattgacgatgcagaatctctctcatatgatgatgaatcatttgacttggttataaaccgccacctgctctggacgttaccggatcctgaaaaagcgctgagagagtggaaccgggtcctgaaaccccgtgggatgatagcagttatcgatggactctggttccctgaatcactctctggtaaatcccgaaggttcctctcgaaacttgggattcttatttctgaacgcagaaacccgttcaagtcatattatccggatgaactgatcgataacctccctcatccgaaagggatggaggccttcgaagcagtgaaatatgtagaacgtgcaggattccataatgtcaccctgcattccctggatgaaattatgaccattcagaggaagtacatgcctctttcaaaccggatagggtatcagatgccttattatctcgtacatggtgtgaaataggttaatgggataagtaattttacattttggtagttagtatgataaaaaaaattattgcaggagtatttctcgttctcctccttatcggaacgtgcggtctggtatatgcggatgggaagaccgtggtaattgggctgagtgaagaaccaacggatttaaatccaatccgttctgcaggtaatgcagtcttttatgatgtaattaaggtttttaatggacttatcaagtcagataacaaccttgagatgataggagatcttgcaagttcatgggaacagccggatcctacgactatcatctttcatctgagagatggtgtaaaatggcatgatgggactgaattcaccgctgatgacgtcaagttcacgtatgatcttatgaccagcggtgaaaatgtggcagtctttccaacttcgggcgaatacagtataatctcttcagttgatgtggtcgataaaaaaaccgttaagttcacactcaaggaggcaagtgtcccctttatggaatggcttgcacttcccattctgccaaaacatatccttgccgggcaggatctgagttcaactgaattctggcaaaagcctgttggaaccgggccttatgtttttgacagttggaataagggagaggagatcatcttcaaagcaaatcctaattactttggagataaaccaaagattgagacagttcggtatatcatccttccagatgagaattcacgaattaaccttctgaaaagcggtgatgtccaggcaattaagatactccccaaatcttcaaaggcacttgaaggtcaggcaggagtaaaaatcatttcaaacccgtcagcaaactggtatggtattaatcttccctatattcttccccagttcaaggatactgccgttcaccaggctattgcctatgctttaaacaaaaaacttatggttgatacgatcttcgctggtcatgcagtgcctgcctatggaccatatcggaaagagagctgggtgtataatcctgcaatagagtttaaccaggatgtagaaaaagctaaaaagcttcttgatgatgccgggtggaaaccaggaaaagatggtataagagaaaaagatggtgtaaaattagaatttgaacttttatatgttgcaacatcagaggaaaggaaagatttagcggttgctgttgcatctgatcttgaaaagatcggtatcagggcgatcccaacatccaaagccaactgggatgagttaaatcagaatgttttccataataatgcggtgattatggcttttggttcaccctttgatcctgacaataacaattaccagatctatcatagttcatacatcggtaatggttggaataatccggctggatattgtaatccagaagttgaccggcttttagaacaggggcgaaccacttcagatagggaggaacgtaaaaagatctatggtcagtatcagaagattctctccgaagatcagccaactccgcagattctcttctcaaactacgtctttgcagtgagtgacaaacttactggattagttccccggatgggtccacatggatctatgggtggaattaacggagaattatggtggaatattgaagagtgggatataaggagttaaatactcatggatcaggctctccttggatatattagccggagagttcttcaaatcccacttcttttagttggaatcagcatccttacttttttactcatgtttctctctcctgttgacccggtagttgctcattttggcctgccgatcgttcagaagatgtcagatgaggatataatgaaagtaaaggatgagtggggcttgaatgaaccacttcatgtcagatatttttcatggatttcccatctcttccagggggactttggtcgttcgcatatttataaacgccccataattgacattattattgaaaagctccctgctactttgtatctgagctttgttgcatatggagttgcgattgttcttgcaatccttgctgcgttgatagtcatcagccgggagggaggattgatcgatcgaattattacaaacaccagttttctcctgtatgcagcaccgagttttttcattgccctgattcttatactggtcttttcagtctggcttggatggttgccttcatcgagaatggtctcaatttcagtgccaccgggtttttttgcagaattagcagaccgaatccgccatattattctccctgctgcagctcttgggatgagtcattttgccctgttttatggatatcttcgttccagtctttctgaatcaataaaacaggattatatcatcactgcacgtgccaaagggatagacgagcgtacgattcttatcagacatgcatttcgaaactccctgcttccttttgtcactcagttaggtttggcaattccctggctaatatctggaagtgttgttattgagactatttttgcatggccgggaattggaagactgacatatgatgcagcaatgaagtctgattttatgctccttataggtctgacactctttaccagtattctcgtgattatcggcaatcttctggcagatattgcatacgcaattatcgatccacgtgtcagatacgagtgaacataatgaaagtaagtacgatactctgcattcctggaattaaagttctcataatcatcatattgatcgcagttgcggttccgtttctccttcctcatgacccaaaccgggctaacctggaagaggctgaacagccaccttctcttgatcactggtgtggaactgataaacttggccgggatgtctttacccggacgatatatggcacaagaatatcacttattgttggtttgactgcagccgttttggccgtctcaatgggagccggtataggaattaccgcaggatttatcgggggaaaagttgatggtctgcttatgagaattgtagatacgataaactctcctcctgaggttatcctgcttattgtccttgcaaccatatttccccggagtatattgactataattctcattatttccctgactcactggatgagtacttcacgattgattcggggagagacattatccattaaagagcgaccctttgttgaggctgcgatagctcttggggcagatgaccggtatatcatgaaaaggcatattcttccgaatctgtattctatcctggtcatttcagttacgcttatggctgctcatgcgatcatgatggaggccatgctgagttttctggggctggggattcctgcacacatggccagctgggggaatatgctcaaccaggcacaaagtgacgtcatgagaggaatatggtggacttctatattccctgggataatgcttgttgctacggtatggtcaatataccgcttaggtgaaggattaaaagagtatctgacaccacacagggattttttatccagaatttaatattttttatggaacagaatcaagaagattaagatacacgtgagtttaatatggagatatctcgagaaaatcaggatccggtcaagaaaaatgtccggatatattggaacgaacgaagcaaaacttttgaccaggatgttggtcatggtgcagatcatcacgaatgccagttatggaaaaatcagctgagaacaatcataggcgacgacaaaaaagatgtccttgattttgggaccggaacgggtatgattgctatcaaccttgctgaactcggtcattctgtcacgggtatcgatttgtgtgaagagatgcttgatattgcgaataggaaagcagaatcaaaagacctatcaatacggtttttacttggtgatgctgaaaacccggagtttcctgatcggatgtttgacgtggtaatttgccgtcatctgctttggacacttcctcatccagatgtggctatccgagaatggtcaaggatttgcagacctggcggggtgattatcgcgatagatggacaccaggagccaaaagactactttcatcactcagatgagaaggatgaatcagagaaatcagatcaggaaaaactatgggaacagacttactcaaaggagattactatgcaacttccaaatggggatcagcttacaattgagtcgttaaaggaactcttcacaacaaatggccttggagatgttcagtcaaagaacctaaaggatattgctgagtatcaccagcgcctgcattctgcgagtgaccatgaacgccagcacgaagtaaatatcatctggggcacagttcagtaaatcaccacacatccatgcttttcactaagcccgtttttgatactgccagaagaatgggtgcatattactgtggttttgcagatatatcagcccttacctcatccattccagaccttgaaggataccgggtccatgattatcctgcagcagtctcggttggaattgcgctctcggatcagataatcaactcccttccaaatcgtgacgatgtatctgtatatcaggcatactgccgtcattatgacgagacaaaccatcaccttgattccattgctacagagatatgttctattattgaggattttggatacaagacttatcacgtcccagcctcatcaccacgaggaccggatggactgacttcagagttctcccataagatagccgctcaccaggcaggccatggatggattggaaagagtgctcttcttatcaccccggaacatggtccacgggtcagatgggttaccgttctaatatcagccccaataccacaggagaaagagccgatggatgagcagtgcggacgatgtaaggcttgcacacagatctgcccggtgcatgcgatatcaggagatcccttcggtacaaaggaaccaggatcattccggttcgatagagctgcctgtagtaaagggttttcagataggaaaaagatgggacttttggcaatctgtggcctctgtgtatatgtctgtccatatggaaaaagaactactaataatgaggcgtacacaagcaagtaaggaatatatcattacactgccaataaactcatactatggatgttgttactctctcatctaatggaaagataactcttccttcaaaaagatgtgagacgttctctttgtctgatggtgattctctagtaatagttgaggagaaggatagcatacacctaaaacccctcataaatatctcacatctctggggagtagattctatggtagatacgaaaagtgcgctaaaagaatttagagacgaatggaataaagatcttgtagaataagttctctttgacactcatgcatttcttgcatttttcaaccgtgaatatgggtctgaaataatcaaaacattaatggatgagattcagaatgatgataatgaggggtatgttgcgactattacccagaccgaacttgtatgtctctataaaagaaatataaatgattctatcgcctgactacgagttacacagattcaacattctaaacttattattctccccctgaatgatgaaattgcaattaatgcaggttttttgtaacttcatgggatttctgttgctgataccctaattgctggatcggcacttgcaattgatgcccctgttgtctctaacggtccccactttttgaatatgggggttcccgtgatcgtgtaccagtcctgaccctcatatcttaaccgaatcgctcatcggatccatcagatcccgtatctctgacccgataagatttgttgccagcacaaacgccatgatcagagcacctgctgagagggctattaagggtgctttatagaggagcggaagcccctggttcagtatattcccccattcaggggttggtacctgaataccaagacctaaaaacccaagtccggcaatcatgatgatcttactcccaagccctagcgttgcgatctccataaccggagcaaggacgtctggtaagatgtgtctgaagagaatatacctgttttttgcgccaagagcccgtgcactctcaacaaatcctctgtttttgattgacatggttgaggagcgtacaacccgtgcatatttggcccagccgggaagtgccaatgccaggataattgagggaactcccggccccataatccctacgagagccaacgtcaccaccatactcgggaatgcaagcataatgtcggtgatcctcatcagtaatccatctactcttcggtaatatcccgcacataagccgaccagtaatccgatgataactaccagtatggtagagacgacagcgattataagcgaaggctgagaaccatagatcgcccggcttagcacacatctcccgaactggtcggttccaagtgggtattcggtcgatggaggcagaaaccggttctcaagcgattgctcgtagggatcatgcggagcgatatatggagcgaatactgccatcagacacataaggataagaattatcagtccgaaaaccaatagcggtcgttttttcagaaccctcatccctaaggcacaaaacccctgatctgatatcgggatatacaccgtactactcatgagtatccctcatcctcgggtcaagcaggtagtatgagatatcgatacagagattgattatgatgaaaataatagcaaaaaccatgatacacgcctgcatcaccatgatgtcccgggaagcagctgcatcaacaaatagacgtcccattccgggcaatgcaaagagtgattcgatgatcatcgctcccccaaacagccatccgtactgcgttcccatgtaggtcaggaccgggacaatggcgtttttcaatgcatgacgcctgattattgtgccccggtccagacccttcgagatcgccgtcgtgatatactcctgttccagctcctcagccatactcgtcctcataagtcgcatggtaacagcaaagagactgatagagagggcaaaggcaggcaggataaggtattcagggcctttgtaaccggctaccggcaggatcttcaatgttatcgagaagatgagaatgtcaaggataccaagaaagaaatcaggaatagacaggccaatgatagatatcgcccgtgagagatgatccagtcttccattcggatgtatccctgcaagaatacctatcgggattgcgatgataatcgaaaaaagcattgcaatagatgagagcaggaaggtcactggaaaggcccgtagtatctcatccgtagtgctctttcgagtctggtacgagtacccgagatccccctttagaacccttgacagccaggagaagtactggatataccagggcttgtcaagatccatctgctcccgcatgattgcaacagcctcttttggggggaaatcggtgttcatcatcgcccgcaggttaatctcagccgggtcacccggggttaccatcatgagcagaaacgcgatgaaggtgataccaatcagtaccgggatggtctgcaggagtctgaccagaatgaactgcttcattggattcacggattaagtatgtgaaaaaagttaggagagggatacctcttccaggtgatacgagagttcggtcggatgcatccggtaccctttcaccttgtcagagtagatatcctggttgacataatagttcaggaacgagaccggtgcttcatcaacaacgatctgctgtacccggtcatagagtgacttacgtgcagacggatcaatgatacctcgtgccttctcaatcagttcatcaacctctgcattactccaccggtatgcaccccatccctcgccagaggtccctgatgaatggtagtcggtcatcataacctcgtctggatccggtacaaacaagagacctcttccgataaggttgatatcaaactctcccttgttacggcgagcattggatgagtcggtatcgattacaaccagctctacctcgattccaaccttcttcagctggttctggataacctcagccgttggtggcaactctgctcgttccggataggttaagagggttatcgagaacttctccccattcttgtcaaggataccatcattattactgtcggtccatcctgcctgtgccaggagtgactttgcttggtcagggttgtatgggaacggctgaatatccttgtttgcccagtaaaactccggtgggaatatgctggctgcgggagatccgaccccttccattacataggtgacgagtgcctaccggtcaatggcgtagttcatcgcctgcctgataagcttatcggtaaatggtccttcatcacagttataggccaggattctcacccggtgaatcggctgatccttcacggtaaatccgcccatagcctggaacttttctgtaatctccggggggttgataagactgatgtcgatctctccactctggagcatcatggatctggtcaccgcatcaggaattgaggtatatactactccatccaccgatggaacctttccccaataatttggatttttaaccgtccgaatctcttcttttggtgtaaatgattcaaaaatgaaaggtccggtaccgattggccgggttatatctccctggtcgatacagtcaggtgacagggcgccgctctctcccttggccatatatgcaggaagtcctgaaaacggggttgaaagtacaatctcaaggacgttatcactgggtgcttttatctcttttattggaacattagcgaacgttttggatttcactaaggagtcttcaagtgatttcttcatcgcagctgcgctaaatggagttttgtcatggaataccaccccgtcacggagggtaaatgtccaggtgagttgatctccggatacctgccagttggttgcaagcccgggaataagcgctgcatcctggttaacatcaactaatgtattttccctaacaatggtatgagtacctgtctatatgcgggtctgttgtctttggactccatagcccgcctacgttcagaatgttcgaactcactgcagtaaaggatgtgagactaatcagaagaagaagtctcctttaataaatttattcatatcttttatttaattattttaatatgtgttacataattgtatctaatcatacttaaatggatgatgacatcgtatttttcttcctgagcaatctgttacagacggaattgtttggcatttttctgttttattcggacattgtaggacaaatgggcaggattcatgagatggtattgactgatcgggtctttgatgtttgtgtccgcgaacgatagactgtgaataggggtgcataggggatttgagtatgccacttccttcctctataatatgtccattatacattactccgactcggtctgcaatatggtctgcaagttttaaatcatgggtgatgaaaaggagagagatggtacttctcttctgaagtgaaaggaggagctggattattgccgcctgcacagaaacatcaagcatcgaggtaggttcatcacagaggataaagtccggctttaatgcaagggcacgtgcaatggctgcccgctgaagttcaccgcctgagagttgatgtggataccgctctgcataatctgggttcaaaccggtttcggcaagaagctctaagagaacattctttaatccccccttttcctgagcctgaccatgtattaaaaaaggctccattattgaccgtgataatctccaccgtggattaaatgcatcctcagggtgctgtggtattatctgcatctttcgtcggattggaatgagttctggaccttgaagatcagtaatatcctcgttatgatagaaaattctgccagtggtaggtgagattagtttgagcagaatttttcccagagtggtttttccactcccgctctctccaacaagagcataggtctctccggctttaatctcaatatctacatcctgcactgcgaaagtcttctggtgactgaaaaacccggattggtagattttaccaagcccagttccggttatgatactggatacacctgacattgtcatacccaacagggaaaagggggatctcttctgagcagaccctactacagagagagcatcgtgacttgaatctgcatcccgcctgtttttcatgcattgccggagaagtaccgggaatcggtgataatccccgctgaggaagtgagtttactagccctactgaataggggtgaagtggagtagtaaaaaacctttcaacactggtgagctccactatctgcccgcagtacatcaccgctatccggtcagcaacctctgaagcaaaatcaagatcatgggtgatgataatctgggtgatgcccctctctttctgtgtgttaaacatctcaatgacatcttttttgttaatcgcatcaatcccttttgttggttcgtcagctattaacaccgatggaatggtcgaggttcccatggcaagcatcgcccgctggagcattccaccactatatgcaacggggtactcctcggcccacttctccggaggtacgatactgtactgacgaagaagtctaatcgcctgtttctttgcttctgaccatgaactatctgtgtggagaactatcggttcagaaacctgtttccagatcttcatcgagggattaaacccaagttttggattttgcgggatccaagcaattttccctcccctgatcttttccatcatcccttcactgagtgtgaggatgtcctgggtctgaaaaataattgaacctgaaatggcagcagtatcaggcagtagtcttagtatagcaagaccaaggacggactttccactcccgctctccccaatgatagcaagggtctcaccatgtatcacggagagcgaaagattatcaactgcagtgagcagatatccctcgcctttaaatgatacagtaagatcagagatctcaataatgttattcatcttcatattctaattagtgctacaaaataaataaaagtattattaaatttattgcagtgaatatttaataatcaaatgtagggcgagagacgggcccttgtacatgaggtatagtatgacagtatcaataaactgggaagagatatgggagagaaatattcaggatattgcctccaggacaacggtggattactgggaatccagggcagaggattactcggatatggtcctgaacagtgcgtttcatcatggagaacagatacggcagttctgcttttcagagggccttgcagattcggaatctcaggtcatagatatcggatctggtcctggtgctctgacgattccctttgcacgaaatgttcagtcggtaactgcaatagagcctgcagcacagatgattcagaaactggaagagaatgcaaaaggggagaatctgaagaatatttatccgcttcagaagacatggcaggaagttaatacgaggcaatttgaaaaatcctttgatcttgtcctctgttgccactcgctctggcattttcctgatattatggtccagttaaagcgtatggatatggtctcccgtggatactgctgtattgcagggggatttggaactagtgaggactctgcctatctttataaaacgcttagaatcagggagatggagtttgaccagtttcactgcctctttaatctgcttaattcgaaagggatgagaccgaatgtaacggtcctaccctatgagactcatcgatcagagcgatctgcaatctcttcgatggagcaggtggtgcagaagtatcgcccgcttacgagcaaggatacggagatcattcgtgattatgtaaaaagtcgattaaaagacggaattgtctcaagtaacgggttgatgggcctattatggtggagggtagcatgatggacgggaagattgactgggaagagatctgggagaagatctatgatgatcggatgaccatcatgaaacgcgactatgcggttgacgactggacaacccggtcacaggattactccgaatcaaggcggtccaataattatgagtatggtaataaagttcttgaagtgctcaggaaacgacatctcgtgtcatctgactcccaggtgattgaagtaggttcaggacctggaacattcgtaattccgttcgcccctcacgttgggcattatactgctgttgaacctgcaaaagggatgatagaacggatccgtgagaatgcgaatgaatcagggataaccaattatacaattatcccaaagatatggcaggaagttgatgtctctgccagccgggagaaatttgaccttttactctcttctacggtcatctggatgtttcgtgatattatggaacaggttaagagaatggaagaggtctgtagaggaacttgttgtattgcagcagggttcggatcagtcagtggacctgagctggatctctgggagagtattatgggtgacattccctacccccagtatccggaatacccgtacatctataatatcctgtaccagaatggcagagtccctaatgttgaagtgatatcttcttcaagtattagaactgctgaacggcttcggacgatgtacaaggttttttattcgctgtataccgattatactccggaagtcgaggagaagataacccggtatctggaggatcacagccaggaccttccggaaggaaaacgggttgtcagggagtatcagactgcagtggtctggtggaatccaaagcagagacaggcggggagtaactgaaaaaaagagttgtatcttcatgaaagaatcgatcgtatcatactggaactccggagcatttcggtataactccggtgttgaacgttttttaaaatcagagaaaggaaccgccggctggaaatctctcttctctgaataccttgggacagccccgttaaagattctcgatgttggcactggtcctggatctatctccataccgcttgcgagtatgggacacatggttactgctgttgatttatcagataatatgctggatcttgccaggaaaaatgcagtagcatctaacgttattgtcgatttccgcaaaggagatgcggaaaatttaccgtttgatgataacacttttgatgcggttgtaaaccggtgggtgctctggaccgtgcctgatccaacatcagctcttcgtgaatggacacgggttgtaaaacctggaggcagagtctgtatcatcgatggtaactggtacagtggaagaaaaaccttcgttcaaaaggtttggaaacaggcatcacggctttatatttcgattcgggagagaagaaatgcatggaagaatattgatcctgaagttattcaggacctctggtctacccatgcaaatcgaccggaagatgatatggttctgtttcaaaacgccggcctttcagatgtgcaggtctttatggatgtaaatcagagagcatttactcttggggatcatctccggatgggtcattgggggccaacgttcctggtaatgggggtaaaacctcaaatactgaaagaatgaggtgttttcgtcacgttcagattgcttagagtatataacctaaattcccggaattcatgacgagatgaaaactttaaccagttaatattgattagattgtatcgatgagaggtaatatatgtagtaaataatatgcctcgttaggtgtatgggcatcagacaatgattttattcaattttcataatatatgatttctttattgcaaaattaactacgaattgggttttatttttcggtattgttatgagtgtccgggacattaggctgtaaacaaacgccacaaatcattgacctccaccttttcggtagttgtcgacattcccatttaaggctaaaatgattttggttaatgaaattcaacgactttacggtgagtatggttcaatatctcgagtttcgcatgaatttaaaaatttcccataatctggtgagaaagtatttacactacattcaggaagtaaggaaaggtttcaggaggaactggtataagatccataaaaacctattcgacctaaacggatattaacaccgcagttaattgaatttctgcacagaaaattagacgggaaaaacctaaaccgagaaagcaaggattatccgctcttgatatcccccagcttgcgcaagccagtggccatcaagtcggatattctaatgtgaagaaggtcgtttatgaatggaagcattctaatgataaacgtaatatatgtgctctttaagatccccctaaaggacattgaactgaatttgactgggcatacgcttatgttgtaattcatggttcattacgaaagatccctctggcaatcttcattttgaattttagtccgtatcgatttggaaaactctatccctcacaaaccacttttgacgttattcaggcacacgtcggtttttttcatttgttggagcagtaccacagacaatcctctgtgacaatgccataaccatttatggtagacggacagatcgatataattcttcctttcttttatgtgctactcattatggatttgaacctaaagtctgtgtttgtgcgagtcagcatgagataggtagttgtgagaaatcgatctctgttattcgtagaacagaattatgtgaaaaaatgcagtttgaaccactcgatgaagataagctccatctgataagcagtcttaatagtcttaatcgctacccggtctatcgtcgaacaaagatgtcgattcaacttttagaagatgagggcctatctgctacctctgccggcattactataatattcgaattatgagcttcggaattcatcaattaaccggtaaggatttgttattggtgaaatagtattacgaaatttaaataaatatatttatatgtgatctattcagaaattattttatgaagtgggtaaaactcttcattttttatgggtgtattctactcttgttatgtaacgtactagtaattgcagataacggagtaacggtgcttgatatcgctgctccatgggatgcaaaaaccagtgatccacatgtcaatggagcaattgcccaacgtatgggaacaaccgaaactcttgtagatattaatgatgaagcaatgatttctccaggacttgcaacatcatgggaggtttcaggcgataaaaaaacatggacgtttcatcttcgtgaaggagttaagtttcatgatggaactccctttacagcacaggctatgaaaaaatccctcgaagattcccttaaaaaatcaaaaacattctctagtgttccgattcaggagataaaagcagtaaatgataatactctagaaattgttctcactcaatcattcccatctctccctgcatacatggcaaaaggagaaagtgcagcattatctgaatcatcaattgaccagggtgacatttcaatcccatactccaccgggccttttatctttagttcttattcacccaacgaaaaatttgtggcaataaagaatccggattactggggaaaagtaccttcagttgacgaagtagtttatcacgttgtccctgaagctgaaaccaggtccctgatgctccgaggaggagatgtggacatagcacagattcttacacctactatcactgaaggttattcatccgatagttcatataccattaataccgagccgatttcacgtgtcagactcatttcgtacaattgcgaagaggggccctttgctgatacaaccgttcgacaggcaatgaattatgcaatcaaccgtcaggatctcatagattatgttcttgaaggagtcggagaaccagcaacaagtcttttcccacccactatgttctggggtaataaaaaaattcagccattttcatataatcccgaaaaagcaaaaaccatgctttctgatgcaggctggacagatagtaataatgatggtatcctggataaggatggagaaaaattctcaatttcacttgtaacatatactgaacgtgctgaactcccaccaatggctgaaattattcaggatcagttgaagaaaattggtattgatgttgaagtcaaggctgtggatattgatacatctgaaaatttaaaaaacagtggcgattttgatatgtacctcgggggacgttctttgttaaacgctccagatccagactggatcctaatggcagattatcattcatcaggttcattcaataatggatatggcccgtaccattggaaaaatgaggaacttgacgatttattaactcaggcaagagaacttaccgattcagcggccagaaaagaaatttatgataaagtacagcagatcatcaatgatgaagctcctgtttcagtccttagttattatgtgaatcaggatgtaacctctaaaaatgtgaaaggatatcgcatgcatccaacggaatttgcattccatcttgaagatgtatctctatcctaattctctttttcatctgtattatgccttcatttattcttattcgatttcttcagacaattcctgttttaattggtattacttttattgtctttactttacttcttttctctcctggtgatcctgcagtaattaatcttcgagccgttatgaataccgagcacccaccacaagaagccattacagcgatgagaattgaaatgaacctagataaaccctggtatatccagtactggtcctggatttcacgagtgatgtccggagatatgggctattcttatcaaagtcggagaagtacaattgaagagattggacgtgcatttccggtaacactaattttatcaacgatggcaatggttttttcctgtgttattgctatcccccttggaattttatccggaatgagacaaaattccattatagatcatttttccagggctctttcaataataggtttgtcaattccggatttttttattggcattcttgggataatggttttttcaatatatctgcactggcttcccgtcgcaggataccagggacttaattatctcattcttccggcttttgccctttcagttggcttgtgtgccatttctatgagattgatgagaaccagtatggctgaagtactcgaggaagattatatcaggacagcgatatcgaaaggcctttcaaaacatctggttatccaaagacatgcaattaaaaatgcaataatacctgtgataacctatatgggaacgcaatatggatggttatttggtagttctatgattatcgaatcactatttgctattcccggtcttggaagactttttgttgaatctgcttctacccgtgatattatggtactccaggggtgtgtgttgattttcgctcttgtttttgtttttatcaatcttggaattgatattctgcaatatctttgtgatccccaggggagagtagaatgagttacttggataattatttcagttcatgttatgaattataccaggaatataacaataaaattagaaaaaagccattactcttaattggatttaccatcttggttatgatgtgtctgattgcaatttttgctccgattattgctcctcatgatccaaatgatcaatcattaaaagaccggttcaagagtccctgtcttgaatatccacttggtactgatcaatttggaagatgtatttttagtcggattgtgtatggatcccagacttctcttgccgtagcagtgataacaacaattattgttgtatttatcggactattggtggggttatatgccggatattatcgaaaacttgacggtctgttgatgagggttactgatattatgttggcatttccatcaatggtaattactcttgcactggttggtatattcggacctagtattccgaccattatttcagctcttgcaattcccgggtgggcaaaatatgccagggttaccagatccacaaccttatcaatcaaaaaccgagggtatgttcaaagtgccagggcacttggggcgaaagatagatacattatctttaaacatattcttcccaattctcttgccccgatcatggaaattgcaacattagggttgggaggaaaaattatttccattgcaggacttgggtttttagggcttggaattcaacctcccacaccggagtggggaactatcatgaatcaaggtctcccgtatttaggaaaggcccccctgattactctttctgctggagcgatgattctggtatttgttctctcatcaaaccttatcgggagtgaaatccgggatgttatggatccaaaaacagattctatcatcctgtaattctttttccgaagaaatattttgacgtataccaggattatcaggctaacctttttaagaagttaaaagacactcataatgatccttttccattgtgtccatcaccaataacggctgtatccattctgaaaagtaatttttattcattatttcacactttccctctgacatcacaccgatccgatcacacatcacctgcatgacctccggatcatgggagatgaaaatacatgccgtagagtttttcttctgcatctctttcatgagattcaaaatttgtgcctgaactgacatgtccagcatggatgttggttcatctgcaataagaaggtggggagagagtgaataaattctgaccatcatcgctcgttggagttcaccaccggagagttgtccgggatatttatccaggatacccggatgaagaccgactgcatggattaatgggagaagggagtgtaatacatcttcggattcgcccttttcatgatacactagtggttcagtcacactatagatcaagcgtcggcgaggatcaaatgatacctccgggtgctggaataccatctgcatttttgcctgcagacaagatcgctcctttcggtccagtctgaaaatgtccttcccttcaaagagtactgagccttttgtcaatttttcaaggcccaatatacaccgtcccaaagttgactttccacatccgcttggaccgaacagaccgatagtttctccggcattcagagtgaatgacacatcacggaagatatctccatggccgaaggttttcgagagatttgttacctggagaaccgatgacatctcacactccttctcccatttacagggataattgccggatggattgtttttccttgttcacactgatacggacacctgctgtaaaagtagcaccccgaaggaagatcgataagacctggacacatacctggcattgctttcattccgttccggggcagagcggcgataagtccctctgtatagggatgatgggggtcagaaaagatctcatcaaccgggcctgattctattatctccccggaatacaggacatgaatagtatctccaatcattcgagctagatcaagatcatgagtaataagcagatgtgtatctttcctgatatgtttcaggtgcagaaacatcttcatcgaggtttttctggatgaataatccagtcctttggttggttcgtctgatacgagaagtttgggttcggaggccagggcaatccctgttgtcactctctgacgcattccgccggataattcatgaggaaatgaagcagcagtcagtttcggatctgaaaattgaagattagaaaggatattctctacttctgtactctgctttaagttcgaaatcccacgtatttcaagtgattctgatatttgtttcccacatctcataagggggtctaatgatcctgacgggttttgtggtaccagggagatatctcttccgcggaacctggaaaattctttttctgacattgagagaatttctctcccattgtagttgattttgccggatataatcgcagcctcagggagcagatgaagaactgccagcccgataacagattttcctgaaccagtctcaccaatgagaactgatatctctcctttctgcatccgaaaactcacctgttgagaggctctgattgctcctgctcttgtaggaaaggtcacgttaagatccattacttcaagaacggtattcacaaagatccctcattgtctgtctttggatcggtgatatcacgaattccttcgcccgtgatattaaagagaagagtaacgcacgtaattgcaagtccgggaactattacattcagaggagcaatacgcatatatggcagcccagaattaatcattgagccccactccggaatagccgggggaatcccgacaccaaggaatgagagggttgcaatggtgagaattgcatgaccgatatcaatcgttgcaagtacgataacgggcatgatacaatttggaaggatatgctttgtcatagtccaccatccgggaagggctgcagctttggctgataatacatattcctgatttttttctgcgaggacctggccacgcgttagtctggcaaacgatgcccactgaacgatggacagcataattatcatgtttaagactccgcttcccagaagcatcatcagagccagagcgaggattacggatggaaatgctaaaaatacgtcaattattcgggcgatgacattatcaatccacccactttggtatccggagaaactaccaatagtaactccaataataaatgagatcacaattgtagcgagtgctatctcaagtgaggtttgtaacccacagatgacacgtgagaagagatctcttcccaggtaatcagtaccgagaatgtgatctgcagaagggccttgattttttccctccagatctgtaatattcgggttttggggggcaatatcaggagcaaaaaaccccattataaggatgatgacaattaatacgcatgctacctgcagatcacgtctcatcttaaacctatagagccagtctgacttttgaatggatatggagatttttctgacctgtgtggataatgtacattcactcataggttatcctcgggtcaatcacgtggtatagaatgtctatgacgaaattcacgatgagaaacatgaacacaatcaccatgattgtgctttcaatcaccacgagatcacgggctgaaattgctttcattaatagggctccgatccctggccatgtaaatattgtttcgatgatgacagaaccggcaaggagtgaaccaaatgacatgccaatcacggtaagaactggtaaaaacgcgtttttaaaagcatgagagaagagaattttctttcttgaaaggcctttagcttttgaaaatattataaacggtttttccatagtatccagcatacttgtcctcataatacgagcaattgacgccatcgaatgaagtccgagtgctattaatggtaaaattatgtattttggctcaccatatccggcaacaggtgtgagattaagccagagggaaaaaatgaggataagcataacagcgacccagaatgaaggcatggaaattgaaaagatagtaatgaaccgtatgagatgatctgctgttttattctgatgaagagcagaggcaattccaagagctataccggtgattattgcaaaggtcatggcaaaggaggtaaggagaatcgtcggcggaagatacagttcaaggagtttcccgactgatttattataaattatggaatttcccaggtttccagataatataccccgtatccattcagagtactgttctatcaaaggtttattcagatcatatcgtgcagagacttctgcgatcagttctggtggtgctgattcctcaagaccaagaaacagatgttttgccaatacttcagcaggttctcctggaatagcattgacaacacaaaaggtgaagaccgacgcgataaataaggtcaggatcaggtatccggttctcatcacaatgtactggtgcatctctcacgctcgttttgtgccggaaatgagatagtacgtccccatcggtttaattttctgataccacataagccggtgatgctggtttttcctgatatgcatgagattttctgttattatatcttcaaatccggcatttttgaaataaatgaccgcttttgcttcagagataccaccgatgtgaggaaggttttgttgtaattgtggagaataatcaaggttctctgcagtatcaggatctaaaatccttcccagatattcactacatctccggcagattagcgatttcaatcttttatcattccataatccatcgatgattattactcttcctccgggttttataattcgtttccatgacttgagggccgtttcaggatttggtaacgtccaaagcagatgacggtttatgaccacatcaaagtggttatctgggaaaggaggattttcggcatcaccatggagaaatgtcatcgacagtgctctctcttttgtttttttccgaccttcatccatcatcttctcagataaatcaaggccggtcacctgatgccccatctctgcaaatataagtccgattgcacctgttccacatcccacatcaagaacagacagcggtttgtttccttctggcagtacctttgcaaaagcatgtatccagagtttcttctcatcatccgtatgaatgccatgtgatacaaaggtatcataccgggaggcactctcattccatctttctgaaatttcggtttttatctgttcttcatccataatttctctcacataaaaaaaccaatgttcttccagctttttcacacaatgcattataaaatgaataatgagtctctgtagaacatggccagattacctgaaatgccaccaaaaaagtgatgattatgagatagacatccctgggtcaatccggtaatcatgagccgttggatcgaaagtatatccggtcacattgtctttcatgacaatggcaacgccataatatgcaacattgatagttggcagatcatcatatacaatggcctcaatcttacggaaatgatcataccgctcggtttcattcacgatacggtgtccatcgatgatcatgcgatcaacaacaggattgctgtattttgccttgttacttactccattggttgaataccagcctttgagcacatactccgggtctgggaccatggcaaggttggttgctgaaagatacagatcccagtcatctcccattgctttggaaagaacagcgttctccatggctacctgctcaacttttatcccgatattttccagatttgcagaaattgcttcctgcatcggcggaagtccaggacgttcggtataggtgaagaatttcaatgtgagtggttcaccctttttgtcaacatatccatcattattcgtatcagtccagcctgattcggctagatattgttttgccagggatacattgtactcatatggctgaagagttgtattcttccatttcatgcttggaataaatacgccaccggcaggagaaccaacgccatagagtacattctttgcaataccggtccggtcgattgcatgagaaatcgcttttctaacatttttatctgccataaccgggttattcagattacaatcgatcttatagagtcgtggggtgttgtatttttcaacccggattccatcaatagcatcaagacgatcgacttcgctgtatggtggatcacaggtaaattcaagatctccgttttcaatcatcatagcacgggtcgccggactctcatatccgcggattatcatcttgtcaaaatttgcctgccctttccaccagtcggtgtttttgacgacagtaagtgttccggtctgttcatcaaaggattcaaccttcataggccctgtccctatcggatgagtaaatgtaccatccgctgcgtatgaatcaccgcttacaatcgctgtatccggatagtgtagaattcctggcacaaggggattgagttcttttgtgtgaatgcggatggtgtaatcatcaacaacttcacatctgtcatacgacatgagtgttgcagtacttggagacaggttggcagttctgtcaagagaggccttcacatctgcagctttcatctctttgccattatggaaatgaacaccgggacggatcttgaactcccatgtggtatcatctacctgataccacgaaagagcgagattaggcgttaattcaaacttatcatttgcgccgattaatgtttcagttacgattgctttttcagtaacaaaggttcccccgtcatgtccgtctcccggattaatagaagagacagcccatagatctccgacacgaagaactttttcggatggggcctctgttggtgtgatcgtaacagcaggtttttcagatgctgtatcaacaggtttttgggttgtatctgttgaggtacatccggctccgagcaggaatcctgccatgaggagtaccagaagcagtccataaatctttttcatacctattctatataaaattaaattttaatatagatagtattaccgaaattatttttttagttacttgtatgaatgaatctctaattattatttttccttgtttattcattcataataatacattaaatggcatatcctgcaatcgagatatttggatttccctgatataccattgcactggagacctccaatctaattcttatgcagggtagtctttcagcactccctgactttttcagacttggaagacggaccagcagaattatcctgataaatgtggtactgtcccttctgcttaattttttactgatagtgttagccggaacaggggttatatccccagcactcggtgcagttggccatcaggttgccctcgcgatagcccttaaaaattctgcacggcttgcgaatacaaaggtggagtcagattaagtattagccaataaaaaataattatattaaaatattaacaattcaaaaaacgtaataataaatacaacctaaacgtacatctgtatgtttcgttcattctcgaaaaccttttttctcgggtttatgatagtttctctcctcgcaggaatatgtgtatttcctgtttcaggagaagagacaacgattactgacggtctcggaagagaggtcacggtccctctcaatccagattcggtaatctgttcaggagccgggtgtctgcgatacctgacctacctgcaggcacaggataaggtaattgcagtagatgccctggaggttaacatctctccggacgattcacgtgcgtaccgacttgcaaatccacagtttggcgatctccccatctttggtgagttcaggaaggatgatccggaaaagatcacaaatattggtccacaggttatcttcaaaacatacacaaacaaggatgaggcaaatcagcttcaggaaaagaccggaatcccggtagttgcattacaatatggggacctggttgatgagtatgaggatatgcagaaaacccttcgtctcatgggaaaaatcctcaataaggagaaccgtgcagaagaggtaatatctttcttcaacgaacggaagaaggatctctctgatcggacgaaagatgtacctgatgcagacaaaatatctgcatatgtcggtggagtgggatgtgccggatcacatggtctgcaggggacgtcatttgcatatactccgttccagctggtagcagtcaaaaatgttgcagcagaatcagcaaaacctgatatggattgtggtgatgttgcgaaggaatctatcatcgggtgggatccggacatggtattcattgaccttggttcacaacaactcaagtcccagggtgcagatgcactgagtgaactgaagaaaccagaatttgaggatatgaaggcggtaaagaacggggatgtatatggattgctctcctttaactggtataccacaaatcaggagagcgttcttgcagatgcctattacatcggaaaattactctatcctgaaaaattctccgatattgatccggtcagtgaggctgatgaaatctatgaattccttgttgggaagaagttattctcacagatcaacagggatggatttgaaaatttggcatttacaaagctgagtatgcaataaggagagaggaagtagtaattcatgcattttgacaatgaagaattaccagcagcttatctccagtatacccggacgaagatcattatcctctgtatcggggtaattattctcttttttctcctgatattgtcaatttcaagcggtgcggtctcgatacccccgattgaagtgtttcagacattaataggggagtctgtatcgccaaaatggaataagatcatcctgagcatcagacttcctcaggcattgactgctatcgtagccggtgccgggcttggatgtgcgggtcttgcgatgcagtcgatcttacgaaatcctcttgcttcaccatttacctttgggattgctcatgcagcagcgtttggagcagcattctcaataattatccttggttctggtgtgatgcagaatagctccatcaatccgtatgtcattgataatcccttcgcgactacatttgtcgcatttatctcctgcctgttggctaccgcagtaatcttattgatttcccacctgaaacgtgcgacacctgaagttactgttcttgccggagttgcaatcggttcattatgtactgccgcgaccatgtttctccagctttttgcagatgatactcagcttgcagcagtcgtattctggacctttggggatgtgagcagggcagactggggagaacttgcaattatggcagttgttactgttttatccctggtatatttttactatcaccggtgggactacaatgctatcgatgccggtgatgagactgcatcaagtcttggggttcatgtaccaaggattcggattgtaggaatgatcgttgtttctgtgataactgcggtgataatgtcatttttaggaattattggatttgtgggtctcatctctcctcatatcatccggaggatagtaggtgatgaccatcggtttactatcccggggacgattatcatgggggcaattttacttctggcatcagataccatcggaagggtgataatagtcccacatgttgtacccgttgctgtggtcacctcattccttggtgcacccatgtttctctatctcctgatcagggggtataatcgatgattcttaccgtcggtggtttatcgtttcagtataaaagcagggaaatttttaatgatgtgacattcgacctgggacgaaatgaagttcttgctataatgggaccgaatggggttgggaaaactaccttacttagatgtctgaatcttatcctcaaaccaaccgggggaacgattatggtagaagaacagaatatcatgcatcttgcaaagcgtgacgtggcaaaacggctcgggtatgtccctcagaaacaagaaagtggaagaatgacggcatttgatgctattcttcttgggcggcggcctcatatcacctgggatatttcagaaaaagatctgaagattgttcatggagttataaagcggttaaacctggaacatctctcccttcagtatattgatcagatgagcggaggggaacttcaaaaagtatctattgcaagagctcttgtccaggagcctgatttacttctccttgatgagccaacatcaagcctggatcttaaaaaccagcttgagatactctccgagatccgtaatattacccggtttcattctgtctctgtcatcatgaccatgcatgatctcaaccttgcattacgattccttgataagttcatctttctcaaatcagggatgatttattctgcaggaacctgtaaggatgttactccggagatgatccatgatgtctatggtgttcagacagcaattaatgagatgtatggatatccggttgttatcccgttaactggataaatgatatatggcatctattattgaaacacacgatcttaccaaacgattcggttcacacactgccgtgaacaatatatctctgactatccagaaaggagaggttttcggactactcggaccgaatggtgcgggcaaaaccacttttttatctatgctctgtaccatcctgaaaccctcctccggttctgcacaaataaacgggtttgatattattcgtgaatcggctcaggtccgcaagtcaataggtattgtttttcaggatccaagtgttgattctgatatgacatcccgtgaaaacctccagatgcatgctgatctctatggggttccgatttctgagcagaatgtgcggatttacgaggttctagaactcgtcggattatctgatcgggctgatgatttcatgtatacctattccggagggatgcgaagaagactggaaatcgcccgtggcctgctccattatccccgtgttttgtttcttgatgaacccaccatcggtctggatcccaggagccgtgaacatatctgggattatatcagaaaattgcgaaaaagagaagagatgaccattattctgaccactcattacatggaggaggcagaccggctttgtgatagagttgcaattattgataagggaagcatagttgcgatggacacgccttcattattaaaacaggaagtagcaggagatactatcataatgggttctgatcagatccagaatctgtcagacgtgctgatacgggataatattgtacaagatgtgtcctttcaggggtcagaaattaaaatttttgtgcagaatgctcaattcctccttccccgaattgtcgaatcagcagttcatgcagggatacggattgaccatattaccatcacccatccggatatgaatgacgtcttcatccattatacaggaaaagacctgggtgggggagaggtacgggagcagaccggcagggttgccatgatgaagaggcggagagccagatgagtgaacttcggggaatttacaccctgtggcttcgggaagtcaagaaattcctgcgggaaaaacccaggctattaaacgccatctgtcagcctctgttatggctttttatctttggaaccgggatgcgattttcatctggtatgcctggaataaattaccaggagtttatcttccccggactggttgtccaggcaatgttgtttactgctatgttcatgggagtgtcggtcatatgggaccgggaattcgggtttctaaaagagatcctcgtctctcctatctcaagaacgtcagtctttctggggaaaatgcttggcgtcagtacagatgtaatgatccaggggattatcatatttccttttgcgtatctgattggaataccggttactgtgttcatggttttcgaggctctgccacttatgatcctgataacaaccggtcttgtgtgtattggccttacctttgcaagcctgatgaaaagttttgagggattcgggctaattcagacgtttatcaatctcccgatgttctttttaagcggggcactctttccgcttgccaatgttccaatctggcttcaatgggcgagttatctaaatcctctcacctatggtgttgatgccctccggacggttatgatgggagatacctgggtgcagctctttccgatggaactggatatcctggtcctggtttgttttgacatcattatgttcatcatcggaaaaacagcattctgcaggacagaatagtccaacttggtcacacaatctggttgaaaccaggatttaatcatcctggtattttttcgcgatgggatcgacattatgcgggaacatcgcactgaatggatccgaacgtccagtgtcagttacggtgcaataatgcatactggtatcagatccggtcatgaggagtggttctgcccgttcaacatcccatgaaccatccggcctgtatatctcatcaagaatctcaagatgtacaactttcccgataatgaggatgtatgatggctcttcaatgagtttatccaatgtacattccatccatgcataacagcccattattcccgggggttttacgacgactgatggtttctcatcaagaccggctgaaataaattcatcctcttccggaggagaaattcgggcagtcgggatgactgcatcagttaagtcggttgtagccatgttgatgacgaactccccggtttccttaatattgtcaagggtatcccgtcgtttggcggttgcgatgcagaccagatcaagtggtcgtaatatgggcatgacacaggaatatggtgcaatatttctgatgccttttgaactgatcgttgagataagggttattggaaggggaaatacagattccctcttcattggtttaagcttcataattgtatcttctcctgatgtaaattcagggttttgtgttctgttctcttacatcccagaccatcatgccggttattacctgtgatcgggcaaggtattttccatcttgtgcatggggggtgatatactccctgatacggtctttcatctggtcatcaatctgtcttgtggtgctgaaaaaaccagcagcagtctcaatatactcatctatcgtctcgtaattactccagtcatcctcaagaagggatacttccggccggtatccgagcagatacaggtacatgaacgggaggtaaaacccatggggtgattctttgaactcctcatgaaacagagttttgtagaggtcatagtatgagggatcccattttcgatgaacccatccactgtaatagcagattccttttgccgtttcaagcatgagggagagatcatggggattcctgactgctggtgtcatggatgcaataacaagatcaaatttctttcgaaatccttcctcatcaggattgattgtgtcccaggattttaagattgtctgaatggtgacgttctcctcatctgcccgtttatttaattttttcagcatctcatctgaaaaatcaagggcggtcacgtgagcacccatatgtgcaagtgggattgagagagaaccagttccggcaccgatgtcaagaacctgggatccttttatgtcaatgcctgtactgataatcaggtccaatatccttttcagtctggcttcttctttttcctggggtgtgtcccgggcatatcggtgagccatatggttccagaacgcgggagtcaaaggtcctttcttgtttccggtttgggttgtcttttcccagaatgcagcccaacaccgcgaattgtcgttttcattcagattttctgtcataggtatcattctcaaggaatagtctggtttttttgcatagtaggtttatgaagatactatgtattttatatcagatcgtaagaatactttctgatttaatcacaaaagatgagatgctgatcaaggcttaatatactgagatgataataacaattcatctatcgataattttttggtttctgtttaaattttcaggaaatcttgaaaaataggtcacacattttagtcttatgtcgcatcttatttacacatatacaatcttcctttcatgatccttcatgagagtaatgtgatgaattcatgcatgacagctttatggcctgatacctaacagagccaaaatcagtgttacttatcaagaatacattttcaaatacaaatcgatacctttatatattttctgcgccgccctacggtgagcaccgtcgggcgacctaaagaatatgaagaagccttcttctaagggtctaaaaaacctaaaatcttgggtatttcaaaaatttacctttgattttattgaaaagacagctcgggaaacaggatttatgcagagaaaaaggaaactcgatcctgttcttttgatatttaccctcatttttggagtcagcagtcatatgaaacccacattagacgagatccatcgtcattatattgaccttgatgataatccaaagatactaacctcaattcgtaaccaaagtttcaggaagcggtttaatttaaaattagtagattttctgaaatcactgatggaacattatatagatcaaatggttcatcagtctcctgctcatttaaagggaattgtagggggtttcaaagatattttagttcaagacagcagtattattcgaattagtaaaaaactctatgaattgcatcctgcagcacgttctcgcgatgaatctgctggattaaagatccatgcaatttatagtgttgtttctaattcagtaaaaaatgcaattataacaacagaaagggttcatgactctaagatgttaaaaattggacctgaaatagagaatattctcctaataaacgacctgggatactattctctaaaaattttctctaaaattcaacaatatggaggtttttttgttagtagaataaaaagcaatgctgtttttaaggttgtttcaatcaattcaggaccttctgaaataacatcaattgttgatcatattcgttttaaaagcattaatggctacgattttttagatctaatgccaaaaaaaggagtttatgatctcatttgttcatttcatgttggagacaagcggattaacaaaattaaaactccaatttttcaagaattcagggtaatttgtacctggaatcctcttactgaaaaatggcacctctatatcacaaatatcagtaaagagttattttcggctgatgatatttatgatttataccgatttcgttgggtgattgaacttatttttaaggaattaaaaggggattacgaccttggaaaaatgtttctcggaaatgagccaatggcgtttattcacatttattccatgttactacggtttattattagcagagatctgttttcctggattgtatctacgtctcgaaaaaatgataaaggaaaatataccccgatgttatggtcaaaagtattttcagagaaaggattggagtttttgagtgttttgaatcaaaatttatttggcaaagggaacgtaaacaaacgatgggttaaattagaaaaatcactgcggcaccttgcaaaaagccgcaacataaaagaaactctctcattgaaattttctgaaattttgtaggtctttatcttcggatcgatagtctgaaggagggttatgtactattagttatcgttaaaaaaccggaaaatactcgtaattctctctttttttctatcgtctctttgaagtttcaatgattgtagtttagaccactatagtgagacatttgcgcgtctgggttaaagaaatggatcagagaagtatctctatcttcatgataagacatacagtgtaatacgaattattgaaaaattatgcctcaagatctggattaatctacaaagctgtcttacatgaatccctcttcacagccatggggacgaggcataaaggaatcctccggacattcggactgggatcgaagacatccggcacgatgacccttaccctggaggttatccgttccagtatgaatgcggcattacaggaagaaggggttttatattgctcatctcatcttgatttttttgaacgaatgatctttaaagagaacgatctggataaatttttcacacaattgctacgatcagccctgataatatcatctctgaaagatgttgatcccgatgcaatacttaagagatatctcagccggattttgtgccagatagatggggcataggatttccaatgaaggctgttgaacttttctcccggttcgagcaggatattccaccatcttatgcagtaccgggtgatcaaaacgggtatattggaactttggatcctcatatcttcgatgttcagaaaatacttgttctgatggattatattctgccagaatcaccaaacattgactattctctctatgatttgcttgtacttcaccatcctccgcctatatctccggtaattcctacatatgttattcattccaattgggatattgtcacgggtggtgcatgtgatgctctagcagatgccctaaacattacctctttcgatgttctggatgaatcaactggaatcggaagaattgggggaattgatcgggagacagaagatattatcactcagggtcggtttattcatgaaatcatggcaacgctcagagtccatgatattcggaccgtgaactgtaaccgatttcaaccggttggtacaatctgcgttatatcaggttttggacttactcctcctctcatatcaaaagcgatcagcaaaggagtggatatcgttgtatccggcgatttaacccatcctggggcggttcttgcaaagaatgcaaacattaccctcattgatgcgactcatcatgcaactgaattgcccggattgtaccggcttggtgaaatgatctcatcatatggcctggacgtacaggttagaaattttggcatcccatggacgaggagtgtgaacaggggtgtcaggagagagtatgacaatcattgagatggaaaaccagaaaattccgaggggtcatgtcactctggttggccttggaagacttggatttcgcatagcattggatcttattcaggtacatcggggtggtccgaaaaagatcacagtgatagatggacagaagatatcagcagaggacatcatatttcggatgaatgggggcacaatcggagaatataaagtcgatctcctgcaccagttgtcacatccacaaaatacacgtcaaattgaaaccatccatgaaaacattgcaccccataatcttgacctgattactggtgatgtggttagcattcagattgctggaggcgatacccttccggttactgcgatgatcgttgctcatgcccattcctatggtgccaaaactatcagtaccatgggtgtatctggtatcggtaatgagcagatcagagccctggatatcgattcagctgaccctcataatccgattgtgaaatctcttcgtgaccagcagattaagggccacatattagttgggaccggaaaactcatccgtgactgggaaccggtgaccccccatatcctggatcgggtttctgaggtaatgacggcagaaattttaacactccttcatgaaacatggttatcagggtagcccttgcagaatgttttacgcatgggttaatctcacgtgagattcatgcattttccatgggatatccccttacgtatcattggagcactgacccggaagactttccaatatcggtgatagctggtcttttcatcccgacattgtcaggcattcggactattcttcactttgagccccttcctcctgctgaagtaataaatgacattaagatatacaaccaggaccaggatctgctaatggcttttttgatggcccaggcagtaaaaaatctgacctgtgcagatattggcatcggaacctgtgccggtgtcgggaaaggggggatagccctggtctatgagaagggaagtgaggtaattacatcagaacactatgctgatctccgattctcatctgcatgtgagatcatgtccagacagaaatccggggtagtgatgtgtcttcgccattttgaatccatattgaatacaaaatttaagaattgtcagaaaattattcccagtaattaacgaataggtatattcttaaatttaatgtatatcatattaataaatgcaaaaatactaaaatttttaacacatattcatatgtataaaatttttttgggttgtattatgcatgatttaattagaaaagccataaatgaccctgatgctgcatgggaactctctaaaatcgaaaagggtccacgtgacgtcatcgacgcggtcacgtcgctaaaccgtgaagaagcaattaaactcggaaatacctttaaacggttccctctggggtgtgatcttacagaaatacttgtaggcacctgtgcatctgatcttgaaaagactgatattttaggcaattgtatgcttgccgatagtattggagcatctattcatgtatgcgcatatgcctttgcagatattgctgaagcacatggtatgaaaggaatcgatcttttaaaagaagtacgggagataactgaagtacccctggaccttgatcatttcgggagatatggtcctatgaggctgcctcctcaaattatcggttgtaatggtcaatgctataatgaaggacctcctttttccggttgtccacgagatcggattcactcacggcttttggatgttgagcaggatgcgctatcagatcgggatgaatgggtgaaaatttcgtcatcggttgccgtgaatcttacctgtgttcagggtgctgatggtcatgcagctcccctggatgaggcgcaggaagttgcagaccttgcgagaaaatatgggaaagggatcgaggcaatcatgttcgttggtgatggatatgatgatttaataaagggatttaccgcagctcttgatatgggtgtggatgtttttgtcctggaaggagggccttttaactgctcaacagaccgcctcacagcatttgccagggctgtagccatcgcccgcattctggttccggggaagattgtcgctaccaatggtgcatatgaagatgaatgcagaattggacttcgggctggattgaatgcaataattacaggttttccaaagaatcaccacgggtatatgtgtggctattctcccggtaagattaagagaggttattttggattaccgcggattttacagattataaaagaagaggtccgggatcgatggacacatactccaattcaaaaaggtgaattagaagcacttgcacgggcggtgaaggtcgtaggaattgatactgtctatccacagaagatcagatatacgtatgtaggagatgcacattgggcatgtcttccccatactccggtattctcccggactcatgttctcaagactgtacaggatattgtttcaatggcacttgacggtcagattggtgatacggtggctttattgggaggtaggtttgtctcttgggcgattgcaaagaaacttgatggtgttgtggacagtatcatcatcagtgatgttgatccatggattgagcacgtgactattgataatcttcgctctgaattacatactgagatctctcctgccaaatccagtgatacgtatgcacatgagcatgctgatacatcaatcatctgttctacaatgcctgaactggtcaggaaaatgagttggaaatgcggggatgcaattaccctgatttaattttttatgattttctgatagtaaaaatcccttttaattttagaaatcaggatatatctgtcacctattctgcatattgaaatataaaaaaattaccgtaactatgcaacctgaattattatactgaattaatgaaaaacgacgatagcagtatcaggtatatccaaaatcacgtctcaccatgctttctgttcagaacaggtcgtatctcatccataaacggacctctttcagaatgaatatcttcctggtactgctatctcattatatcattatccagccaatctaaaaatgttacgaaatttatttttttagcaatcctgcaaacaatatctgataaacgatttttgaataaattgaaaaattaatatttaatttttaaataaattactatttgagatttttaaccgcgctcaaatatgacttggttggcaataagtattaataattattaaatcacttaaagtgatatatggacaatcacgttgctccacctcatacaattcttcagtggaatctaaccctccctcctcatacttcccagccaggagttgtcatactaattcctgactgggtgtatggactacttcccctatgtgggcccggactacgaaaagacatctggatcagggaggaaaaattcattgatgagatataccgttttttttatcagagcggatttggcgtacttaccctgtcttgtccaatggaagttgatgaaattccatctgatgctaccatattagctgctacacaaatccccgatgcatatgtaacaataaaaaaattaatgaaagaatcctcctgtaatctgaataaatctgtattattcgggcacgggtttggagtgtgtatgatgtgtgagctggttgcatatggtctgaaacctgcaggatttatagttgcaagtggtatctattcggatgttgaatcaattcttactcagaaatatttcccctttaaggatctgaatctgcaatctgctggggtaaagaactattctccggttgatccggatactgcactgattataaagaaccttggaaagatcctgcaggcagcccgaagaggaagagaaaagattaaactaaaggaattgaatcatttcctcgagttaccgattccaaaaaggttattttcagatgaatcatcaccctctgcattattatccacacttgatgccccatcagtaattctacatggttcaggggatctggatatttcagtaacgaatgccttttttcttgagaccaaattaaaacagaagaacaattctgtaagtcggcttgtaatgcttgatgatgatcactggttcagggagatgccacatgatatggcggaacgaatacgggagcgattatctggtgaatgcattcaacacccgattgataagcgttttttaaaaaatgtgcagatatttgtcgaggatgtactaaagattcgtcgaacaaaaaaggatataccagatatcatcacggttacggattcgaccatgacttcatcatccatgccgggaatagaaaaaattatctgaagattgcgggatccatttcatgtcacactatgctcatacatgcagggtaattcttcatgcgcaattgaatcagaattcatgatctctctatgaaaaatgatttattcgtgagtgttattggttttcatgagaaaaatattacccggtatgaattaccaaagtacatgatgcgagaaaaaattctgattcgtctgattttgtctttatttctttcagttttcatattcactgcaggatatgcagaggtgaatacaggagaaccctcacagtcaatgaatctggtcagttatgatgatacagtaggtttatttgagattcggatagtctcaccggagatgcttgaaaccgttctgcttaattatggaaaacaggcagtcccactcaaagttgaacggggtctatttattggcgttcttactcctggaatactgtatttacgtggtgatttgaatgaagaggactttccggtcaggcagattattcaagacagtactgatgagaaagtggggaaccatctgatcgatatcacatttggtcgtgataattcgaaaactgagttgtttgataatacgaaggaatacctcatctggtttgatgcgatgtatcgccctgaagatcttcagacaattcgtgaatttattgaggagataaatgatctctcccagactaccaggttcagtgatgatgatatcgctcttccttcatataagccaaattacaatccgattccctatatttattataaaattagcattgttgacaaagatttgctgaaggaaaagttggataagcgtgatagttcaaaagaacagattctgaaggacaataatggggtttcagtcgcattagttcgaaatgatcatctctttcttctgaatgatctctccggagatgaacgaaaacatttccttctcaaaggacttctctttagcatgggatttcatggggagagtaagttgcaggatagtttcttttataatcatggaattaagactgtattatctccattagataaaatggcaatagaacttttgtatgggggacgtctccaatccggccttgatgttgaggcagtgaagaaaaccctgggtatagtctcaaaagaataatatcaataaaaattgaacaaaaaacaatattttcaatagatctataggatctctagagatcgtaacaacttaattattaataccaatatttcgtaatactatattaacaaaatatgaaacaggagtaatcaaatgaagtggtataccattttttctctggcctgcctcgtagcaatccttctcccggccgggtgtgtattcgcatcaggaccggaatcggatcagtcaccggtacacaatgaacaaacaacagcaccagtatcaaaaagtccatctgaatccggctctgaaatccaacgaacggatgatgatcggtatttttacaatatcaggattgtctcgcccaaagacctggaatccatgaaaaatgaattgaacagtgatgaatcacttatcagaaacgaaaacggtgacatcattggtatcgtctctcctcgaaaactctacatccggggagaccttgtcgatcttcagaaagaaactggcaaggcaggaaagacctttgataaaacagacgttgcagaacatcttgttgatattgtctttggtaatgacaatgcaaaattgaatctctttaaatccaataaggattaccagttctggcttgatgcgtactatacatctgatgatacacaatatcttcttgaattagcgaaactcctgaataccctctctgatacaaccgaattcgaagatgaagaactggctctcgggttcctgaagacgaattatgcagatgttccctataatttctataacatcaagatcatcccccaaaagatgcttgatgagttcaaggataaccgaaagagcgatgagcgtctgattaaggattcagaaggaaaactcataggcattgtaggaaatgatcacctctatctggttgattccatgtcatttgaagatcggaaatactacatgctttatggtacactctatagcatgggaatgcatggaacaacctattcagaaagggatagtttcttctatcaggtgggaggtgtcagaaatactgaattatcagaacttgataaagagtcgataaaattactctatggtggacggctcaagaccggaattgatatggaagagatgaaaaagaccctggggttaaagacatagggctaaatttaccttatttttcctttattttcttcttctcttaattttttacgtcttcagattgagataattttaattcatgataatgctccgttttccatagaatatatacgatctgacataaaggagaggacatcagagtcatgggagatgataatatatgacatcttttctctcttttttacttccttaagtaacctgagtatttgagcctgcactgaaatgtcaagtccggatgtaggctcatcaaggatgattagttcaggtttagtaagaagaatgcgggcaagagcaagacgctgtgcctgtcctcccgatatttcatgtggataccgggagagaatctcctcatgtaatcctactttatgcaggatttctgaaaatccctgcctgggcaaggtgacgcctgggaggttgataagccgattcattgagacatttaattttctgaccggattaaatgaacttcccggatcctgaaataaaatctggatctttcttctcatctcttttcgtatcttgttatctacagatgaaagaagaattgtccgaaaccatatctcccctttatccggttcttcaagcccggctagaatgcgacttaaggtactcttcccacaaccagacggtccacatattcctacagtttctccatcatgcaccatcatggacacattggtaagtatctgctgccactctccagccaggccgtttcgatatcgtttagatacatttttggcttcaatcaataccgatgacatcgtatcattcttccattcacctgtgtaagttttgcaggccttttatggcacaactttgttacctgatagcaccggtctgcaaacctgcatccctcaggaagattggtcagtggaggggcacatcctggaattggattaaacccgttctccggaaggctttgtatcagacctctggtatatggatgagatggtgaggacagaattgcatttgcaggacctgcttcaacaatttctcctgcatacatgaccacgatatgatgagccatagtatgagcaagtctgatatcatgagtaatcaggagcaaagtccttttttcatgtaaaacttcttgtaatgaggcctgaatgtctagaatttttgatctgtcaagtccttttgttggttcatcagcaattacaagatccggctcaagagataggatgattgcagtgacagcacgctggttcatccctccggaacaatgacatggataaagccttgcagccagttcaggatttgaaaatcctgcttttataagtgccttatggatgtgtgcctctctctcttgtacagggacaactttatgtgtatcaagtggctggaacatctgtttataaagccggtagatcggattgagtgccctatctggactttggaacatgataccaatctcttttcccctgatgctctgtaacaatctctcatcaagtctgtaaatattctgatttttaaaaattattgtgccttcaacctgtgaattttttggaagcagacggagaattgcatgagcaacaacagattttccgcatccagactccccgatgattgccgtacatgtcccttgcataattctacaggaaaaactggataccgcaggaatttttattccatctgaaagaaaggtgatggaaaggtttgaaatgtcaagtatcggataaggagaattcattcaaataccatctccggttcattactttcataaatcatacctatccgggtgatagcaagcaccgttacacacatgcatatcgcaggaggaagaaaccaccaccacatttcacgaataaatcccccatgatcaaacgcatctgcgatcatctttccccagctctccatcatgggatcagacaatcccagaaatgagagtgatgcttcagatatcatggcactggcaattgtgagcataaattttggcagaagaaccgggtaaatcaccgggataatgtcatgaattataattgaaaaagatgaaaatcccaggcaccgggaagaaaggacaaatccggaattacgaatctgcatagtctttgtccgtacaaccctggcggttgtctcccatgaaaacaaaccaagtacaatgataagtatccagatgctgggatgcaaatatgctgcaataaggataatcaccggaattttcggaataataagggtgatatcggtcactcccatcatcaggtcatcaacccatccctggagaaaaccacttacaattccaattgaggttccgataaataacgagagaataccggtgaaaacgccaattatgagagatatcctggttgcgtaaataaggagtgtgagaacatcatatcccatgtcatcagttccgaggatatgattctcatcaggttctccatacggcgaaaaacggatatccggactatatggtgagatagtcttgggaaaaatggccgcatatacaaatattccaaggataatgatgcataatgtcggagaatatcccattttttttaaccatgaagggaaaattaccatggtcatgaacttctcctgattcggggatctataataagtgacatgatatctgcagtgatattggcaataatgacaaagattgcaatgataaggagtgatccggtcagtatcggataatccctggcaaggattgcgtcatacataaggctccccattccattcagggaaaagacaatctcgataaaaagtgcacctgaaaaaagaaatccaaagtcaagagcgattagtgctatcagtggaattattgcattttttctgatatgatggagcaatatattccgttcagaaatacccagtgaccgggcaaactgtggataaaggagttccttttcggttaataccgcacctctcatgataagaatatttcttgaagtataaaatgagatcaaaacgaacgttggcaatatgagatggtagaggatactttgaagattataggtatcgtaaaaccctttgaaagggaataaaccgagatggtagacaaataggaccaggacaagaagactgagaagatagggtggggttgaagatatgacaagagctattaaagatattgcatctgaccaccattttccactctgaaaacccgctcgtgctccaagggatataccaatccatgcaccgataataatggagggaatggtatacaaaagagtccaccatgctctgctgatgagaatttcaaaaacaggcccatgcatatgataggagtatccaagatttccatgcatgatctggagacaatatatgagaaactgttcatgaagcggggtatcaagcccaaatgctgctcgtaatgaatcaatagtactctgtgacaggtaaatatcttctccaaccaggttcgagaccggatcaccgggcatcattctgggtaggagaaaaactatcaacagaatgcagaaaaaagaaaggatatatctgagcaattttcgggataaaaaaatacctgccgggtggatcatcaccataaaaaaaggcctggatgggtcaggcagaggattttacaccggtgaaggtgaattcattcatgatcccatacagtggatttgagtaccagccagtaatcttcttgttgtatggggttatatcattcttccagtacagaggaatccctggcagattttctgcataatactcctgaacttcctttgcatacccgttgagtaaggtctgatcagttgtactcaggatatcatcacagagtttgaggaagacttcatcatcaacggtatggaggacaccctgccccgttctcctgctgtcaaaatatcccgttgcccatccggcatgcataagcattccccatggtgtggttcgtgtcagtgtgatatcatagtcaagtttgtctttcatctcaaaccatgtattatcttcaactgttcttacctcaactccgattcctgctttttcaaggtactctttaataagttctgcctcacgggcataggaatttctaattaataggtcaagagtaatatctttcccatctgctgcctctatgataccatttccgtcagaatctttatatcctgctgaatcaagggtcttcttggcagtttcgagattatattccattggttttgtctggatatacccatccatggccggaggaacaaagcccctgttcggcactaatccatatcctagtgttgaaatatcaactagttcctggtaatttatggcactactgactgcttctctgaatgctggatcagacattggctcccttttcaggttaaatcctaaaaatgtgagcccacttgttggtttttccagcatttcaaaattgccggtttttctgagtgagtcaatggctgcatacgggtatgatgatgcatacttccagtaggtgtccattataccgctttccaatgcctttgccgctgcatcttcatttttaaaccagcttatctcgaccgtttcataatctgatatctttcccttccaacttggatttctcttaaaaatcacttttcctgcatttaaatcaacattatccagataataaggtcccgctccgacatacgggccggtactggtaaattcattcgggttttcaatagattcccagatatgttttgggagaatactatacgaggtaaattcaagggcaagatttgtgtatggtttgttgaatttgaaggttactttattaccgtcaacctgtgtgtcaattagtgtctctccaatccagcctgcattcggaatactggtgccatacatctgaatagagaaagcaacatcatctgccgttactggtattccatcactccagaactggttatccttgataacaaatgtccattctgtattatcaggtgatacctcaaagtggtctgctagcaggccgattaattttcctttctcatccatctgcataaggggtggatttgaaagatggttaaaaatgccgagggtataatcgccaataaatgctggtgacttgacttcattcgtggttgcgatacgaagtatggcgtcatctgcaattactcccatagaacagcagattgtgacaaagctcaaaataaggaagagcaaactccagattttgtgatatgtttctctcatgataattagtttatgtgtgtttaaaatattaaaaaaatttgatttgtgttattttatattatattaagttgcattatagaggctgttgcagaaccaaaatgtcatttccgcaagaggaccatttccattcgattggaacttaaatcgtcgaaaaaaaatctgggtttttcctctttgtactaactgtttgaagttatgcaacagcctctatatataaaaataatataggagttacgcagttaacttttattatagaaagatctatatatattgacaacacctataatatacgtgcctataacgaagcagccttcagatgtagattatgtcaattacctcatcgcagctcgatgcgacgtttcttgtataaaagtcgctgattgttattcgacgtctgaattctcgatatcacattataccttcaatcgattcctaacaagacagtctctaactcctgagacgttgtgggctgaagttgaggcatatgttgacagaaaaaggggctggttggttctggatgacactattctagataaaaaacattccaaaaaaatcgaatgtacatattaccagtggagtggaaaagagcacaaagtaatcaaaggaataggattgattaccttaatttggacagatggaatcacttcatttccaattgattatcgaatttatgataaggatgttgatgataagaccaaaaatgatcatctccaagaaatggccttgacagctttcaagagaggatttactcctgcctttgtcttgtttgatagttggtattccggaaatgaaaatttgaagttgattaaccgtcttggatggttttatttcacacgagttaagaaaaatcgtatggtcaatcccgatgcccaaggtattgttcaagtgtcatcattaaatataccagaggagggattagaagtccatttaaagaaatatggatttattcgtctttttcactcactaaatcgtaaaggtgtaagtagatattgggcaaccaattttttgccgatgaataatgaagataggctggttttacgatctatttgctggacaatcgagaattatcatagggcaatcaaagaactatgtggtgtcgaaaaatgccaagctagaaagggaattatccaacgaaatcatattaattgctcacttcgggcatatttacaattcgaagtcaataaatttttgaatggtgttactccgtacgatgctcaatggcaaatcataaaagttggaatttcagaatatattcagaacccaaaatatgcgctataaattttttagaggttgttctgcgtaactcctataatataaaaatttaagatcatggattataatctaaataaaaacactacctaaaaaataacccggagtaatatcttgagagtttagatatttatcctcacagattacggctcatatcgtcttttctcatgcatattttttcttttgactggcatatctgtttcctgcatttcttctcacatcggtctttatcacgataatcacgctctgcagcccactctattagaggttttattgattcccagagggtcagcccttctgtcgtaaggaaatactctacccggggaggaatttcagaaaatgattccctttcaacgagcccctcatgtaccaggtcttttaaggtttcagataacgcctgaggatttatcgaatcaagttcggttgagaattcagaaaacctgagccttcctctggttcctaatttgtaaatgattaaaagggcccattttttagagataatggaaagtatgcctccggtagcacacagataaacatggtctttatcggcacacatgacattccattactatgaatgttatagtttaaatagtatgattatcatagtgaagtgaggagacgaggtgtcgcctatgtgttttccacaccagagaaacaacaaaaccagtgcatgcagtggttataacgcacctgaaccagaaccattctgcaattgccatgagataagaaagagttttgatggaagactccgtgctcttgagaagaaattcgagtaattcatcttctcatttatgggtatcatgtcagatgcaataatagtcaaagaccttaccaaacattttggttccctcactgctgtagataatatctcattttctgttagaaagggagaaatctttggatttcttggtccgaatggagcaggcaaaacgacgacgacacgaatgatcactggtattataaaaccagatgccggggatattcagatatttggcgacaacatggttaccgctcctcttcaggcaaaacagaaatgtggtgtggtccctgaaacgtcaaatgcatatcctgatcttactgcctggcagaatctgatgttcatgggagaggtattcggactttctgatgcgtatgccaggagacaatcagaaacccttctcagggcatttgaattaactgaacatgccgggagaaaggttcagtctttttcaaaaggcatgaaacaacgcctggttctcgctatggccattctccatgagccagaggtactctttcttgatgaaccgaccagcggtctggatgtctcaagttcccgcctgattctctcaatgctccgggagatgaatacgcggggagtgacgatatttcttactactcataacatggatgaagcaaataatctatgtcaccaggtgggtatcattaggtcaggaaagcttattgcgatcgattctccagaaaaactcaagaatacaatagataaacttcaccaggtggaagtaagttttgaacaggaaatatctgaagacctgctcagaattatcccgggaataaagcagatgtctcatattggagacaaatggaagatctctggcgataataacgatgcactcatccgctcactggttcgtttgagtgaacgggaagggctgacgattatttctttacatactctcgccccaacacttgacgatgtatttctccagctgaccggagggcagtattcatgaatacccggattattggtgaacaggttctacgagcatgggctgttgcaaagaaagatatcagaatttattactataaacccccggtgctgatctccggcatactgatgccggtatttctctatctggcatttctcatggggagcaaaccgatatccatgtcttttttaatatccggactgcttggaatgacattgttcttcacatcaaccgcagtttcccctgtcatatttccctgggaaggacaggcaaaaactttagagcggcttgtctcctgcccgatatctcctgaagccatcatccttggggatttgatagcatcctcggtatttggtattgcagtaaccttggttgcacttataattggtctaatactcggagcatcggttttgaacttttttttactcatctgtgtaattattcttggagcactatgtttttcagcaatcggaattctgttatctgttccgccaactgctatcccccagaatatcatgctcttatcaactctggtgaaatttcccctgatatttatatccggaatttttatgccggttgatcagctccctccgctgggccagatattagcctttatttcaccccttacatactttaccgatattgtacggttttcgtataccggtgcaggaagttttccgattagttttgatcttggaatgttgctggcattcacaattatcctgattctggcaagcgtggttctccataaaaaaaccatgccgcttcggatataaattttttaaataaagaatgtttcttgttctttaggaactttttattcctgcgatgatattctggataaccggcataacagactgtgatgaaccggttatctccttcccggcaagtcctgctgacaggaggttctgatcaacagggatttctccgatgattttgtcagcggggagatcttttctcatctgggtactgatttcctgtgtgactttattgagaacaaagtacatcggaagactcagggacgcggccatatctgcagctttttttgcgagaagaacagactcatacgaagggtcaaggaccatcagaacagcatcagctccttcctcaactccccgtccaaagtgttcgagaccagcttcagtatcgatgatcaccatctcgttatccaagagtttgaggtttttcagaaactgtttggctacaaaacccatgggacaggcacatccttcaccggcatgatgtatctttccgatagaaagaagtctcacggtaccgttttctgcaatacaggcagggggaatgtcctgaagcttccattcctggtcaaataactgtagattcataatgccctcagaactcttcatggctgacatcatcttccccaaaagttcctgttttcctcccatctgatccataagatcagtcggatggttcactccaaggaaccggtgaagtccgagatttgattcatcggtatctacgaccatgactttttttccatcttttccataatactctgcaagaagagcggtcagagtgctttttccgctgcctccttttccacaaataagtatcttcatattacatgcaactcctatatttcatgtgatttacatcattttttggggtactgattcgaatcccaccacatacatacccgtgtggtcatgccattttcgatgaaagactgtccgttcatgtaaattttatccttgagatattctttgataagaggatcataattatcagaacacccaatctgccgcctcatttcatagactgcatcgtccatggattgatactttttctcatatttcatctcatgcaccgtcatattcgggtaaatccctttttgatacagcacattatacaaaacatcagatttcggaccatgtgagtaagattcgttatgtatatccggccataaccgttccatgtgccgttcccagggtgttgttcctgcaaaccagaaaagccatatctggccagaagaaacagcgagcattttgtcaatggcagcactaatatcgggcattccaagagagtacgatgcaacaatgatgtcaaatctttccgtaagatctgaagaaggatcgacatcctcccatcgttttggaacaatagtaagattatgtacctgtaattcagcaatctggtccttcatgacttcaatcattccgggagacggttctatggcagtgacatgtgctgcccgttctgcaaacggaaaggcaagtgttccgggacctgcaccgatatcaagaattcggctttcatgggttatcggaagtcgtgataatacctgctctatccgttcagggttttcccgtgacatattcagaaattcaagggcacgctcttttgaattccaaagagaggcacagtctccgacttctttgagtctgctccctgcttcatactgttctttccatatgtgagcccagtctatcattttaatcgtcaaattcgataaattaatgtttgtttatgcttcagaagggctgaggccaggaacaatgcaccgcacccctccgaccattcccatcataacaggaagaccgtatacgtcttcaataatctccggtgtaacggcatcatatgaaccatggaagtgaatatacccgtcttttaaaaagatgaaacggtcagcatatcgcagtgcctgattgagatcatgcatggtcatcactgcagcaattccatgttctcttacaattcctgcaattgttgaaaggatatccacctggtttttcagatcaagactactggtaggttcgtcaaggagtaagatccgtggttcctggacaagtgcacgagcaatggcgatcttctgcagttcacccccgctcatctcatcgatgtacgagagccggagattatccattgacagccggctgaaaatggcatcaacaatacggagatcccgatcactcacatcccaaccgatatgaggccttctgccgagaagaacggcatcaaacgcagtgagtcttccggtctcaacccgctggggaacatatccggcccgacgggcaatttcaagcgtttcaagtgtttggatctctgatccatccagataaatatggccctttttcgcgttaagtatcctgttcaggcatttgagaagtgtggtcttccctaccccgttaggaccgagaatcgccattatttcgccatgatttacttcaaatgcaatatcatgcagtacatcgtgattcctgtacaaaaaaccgagttcctgaacattcagaatcatcgcttataccccctgatgataagataaataaataccggagcccccataaaggctgtaaggactgcaacaggaaggacatatggggcaacaataagccgtgcaacggtgtcagatgtcaggagcaggatacctcccattacgcacgatccggggatcaggtaccgctgatcatcaccgatgattcgtcgtaccatatggggacagacaaggccgacaaatccgatgactccaagaaatgcaacaagaacggcggttatcattgcagaaattgtcattccaaacaacctgacttgttccacgttcaccccaaggccttttgcagtctcatttcccgcatcaatcgcattgtaattccaccggtttaagagaaaataaatgcaggcaagggtgacaaggactgacataaggccgagttcagaccagtttgcacggcttacatcaccaaatgtccagaatacaacagcggctagttgtgtatctgatgcaaaatactgcagaaacatggtcccggcagtaaataatgaagataatgctacaccagtgaggaccattacttcaggggatgctcccctaattcgggagatcataagaattactcccgttgcaatcatacaaaagatgaatgcagatatggtggtgatgtacgggttatttatggtaatcgggttagcaatggtggattgtatctttcctgtccctaaaaatatcaccgatactgcagctccaaatgcacctgcattggatattcccaatgtgaatggcgatcccaggggatttctgagaattgactgcatcgcaacccctgccacagaaagaccaatacctgcaataattgcggtcaatgcctgtggaagcctgatattccagatgattgcatcgtatttatgattcacattttgtccaaaaagtgtcataagaacatcatatggtggtatggagacagcaccaactgaaatggatatgataaacagaaagaataggagaataattccaaaaacaatccagaggtattttattctgacataaccgagataatcagctgggattcttccatcagcgacatgcacatctatcacctccggaaaaaaaggaaatgtggttgttcatcgacatcaaagagagatttgagagaatcccatgtttttatactgggagttaattttgtccagtggagatgaaccaaggaatttggtcatgatctcatttgcctttgcttcaggatcaatatctgcaaacttctctggatagacgatctttccaatgtagtatgcatctgcaagaacattctcataattcgtgttatagaaattgtatgggagaactccgtatacctttccttctttcactgctgttaatccctgaagggccggatcattcttcaattctccaattgctccttcgctgtccatctgtagcgttccaacatccatgaacaggaattcaggatcccagtcaacaattgcttcttttgcaacatcagcatgttgagtccccatttttcctgcaacattcttgatattcagccataggaatggtggatatgccggttcagttgaaataattccatgagctcctgaataactgacacctccgacatatgctgtcttttgttcagactccggaatatccttagttctggatttaagatcagaaatggtctcctcaatgtaagcaatcagttcatttgcacggtcttctttaccaattacttctcccattaaacgaagtccaccaaacatctcggcctgttcagcagccgttcttagtgacccataaggaaacataacaacggggatattcgtcttttcggttaatttatccccttcgacagaatttgttgcagatggctgacctgaagctccggtcttaaaaattaactggggggctagagcaattaccttttcaggatcatcttttcctctgaattcaccgaataaagggtaatccttaaactgtgggttgaggagtgcatatccacgagcatccatggcctgcggttctttctcaatactatcaacacccacaatcagatcctgtccatcaaggtaggtaagataccggagacatccggagcctgaacagataacttcttttacctctgttggaatggtgaccgttctgccaaatccatcggtaattgttctctctgctccatttgaatcagtagccatgcatgctggtatagatacaagagaaaccagcattaagattgcaaccagaatttttgtcaggtttttcatatgatcactcacatttttttgtatgcaggtggtaatgcaattacagcatccccaggactttgtacgggttattcccggctgtcttcaattttgtcaaatttgcctcgtcgatatcaaactccttaagcgtagtgatgactgattcaggtttgtcaatataatccatcatgccgatatcctgcaccagcttgggagcccaggatggtccggtccagtttgcaactccaacttcttcgctgatagtatcaaagtcaaacccaagggcaactccttttcctttcttggctgcatcattccatctgatgattattcctgcaggacgggtcccatactttgccttcagggcggcttcatcatctgggcttaatgccataacaaacatactgtttttaccaggggtactatcccagatcatctggaatgcatcttccttgcaccaattcgggcatccgatgtcgatgtacgtttcagccgactgattcgtgatcggcaggttcttctgaatatatttgattatcatatatccactggtaacacccggacagagatgatcatgaaatgctgcagcgttcatgaaatcataggttgctcctgcagcccagacatttgagagtcctacaagcgagaactcgttcccgccaaattttttcttgttaaaggtggtattcccttcatttgggtttgcaaggagtgtgtccagatttgcactcatgagcgtaacctgtccgaacgccttgtctgccggaagagctgtccgttcctctgtgctcatggtgtagaacgctgcatccggttccatatatgcagcaagtcctgaatccttgttataaaagtagaaccagagccctttccagtccgggcggtttacctggtaaagattattgtcaccatttcgaagaccggacatatcagtaaggccggaaagagcacgttctgtggtctttcctttcacaattgcatggccggcattggtaagggccaggatattgtctgctcccggttcaaatttcaaaagatccatacctacttccgctgcccgcgacccaaggtcatacatgagatcatcttcagctgttgctgataatggtataaccaggcagcagaatgctatcaggaagattatcgttcgtttcattgtattcctcattcatccggaatgattgccattcattaagaaatccgatgtctgttttaataaagtaattttaagccacaatccgtcttaatttactttacaaattttaaagacatcttaattaattatacgattattatgaaatttaaaactattgaaaataatttcataaattttcacaattgagtaactatttttgatagattttctttctttatctcaattttttcaatttaaagagtcactcataatacaattcagacacaaaaacgatggatatatgtgtttccaccgataacctaatatcatatgtgtatttcatcatccgccggagaacccgcccggggcaattacgggtcatatgaacaggcagttgagtttcatggacattcatgcggtggacttgcatccggctatcgggtcgctgttgctgcgctgaaagcactcggagtagagcgtccaaaagatgaagaactggtagcaatcgcagagaccaatgcctgtggtgttgatgccatccagttcattaccggatgcacggcaggcaaaggaaatctcatcattcatgattatggaaaacatgcgtttactttttactgcaggaagagcaacaaagccgttcgtgttgtgaccagtcttgatggattcctgcctgaagagatgaattcgcttagaccaaaggtgttctccggccatgcaacagaggaagaaaaagcacgataccaggaacttgctcatcagggtgttcatgcaatactttcagcaccagaagagaaaattctgaagatacaatttgttgatatgcagccaccccagaaagcgaggatatttcagtcaattccctgtgaatgctgtggtgagatggtagccgatgcaaaaacccgcgaacttgatggaaagcgggtgtgcatgccgtgttatctttcagctacgaatcaatagtttttcccctataatcactattttaaaaagaattggaattataatcaaaggttttttatgtctcatcaattaaatttatttttatctaatccaaaataattgtggttatttcgtggacatatgatatgaacaataatagagtaatcaatgagaaaataattcgaggtacacctttccaaagttttttccaatccgtcggaaatgaaaaaaagataaaagatcctgcggtttctccagtcattggaataatgcttatgcttattgtcaccgtgattcttgcagcgataatatccggttacgttggtggaatgtcagagacaaaaagtaaacctccacaattagttttacaaaccgagttggtaaaaggtgattatgttaacgtttcaatgactgtattatcagcagggaatgggatacccacacgagatttaaagatcataacatcatggacttcaggatcatattctggtggaaatattacagtacccggttttaaatatcccctggggctcgtcccaagtagaggaaacccattagttgaagattttggtaattatacccttctaggcggaacaaaaatgattgtaaataatacggatggaattgaggcttttttcggggatcaatatgcactggtcgatgccggaggtattgttgatataaaaatcattcatattccatcacagtccacaatttacaaccaagagttcattattgaaggagattactgatgacaacggattcaggggtctcgcctgttattggcgttcttctcatgttaactttgaccttaattattgctgcgattgtgaatagttttgccggaggacttgtggataccaaagaaaaacctccttcggctactttgcaggccacttttcatcaaaatcgcattgctgatcccaacaatgccagtcttttgattactcatgtttctggtgatccattacctgtatctgatatctcaataattttaaggcctacccggacttttggtgatgatgcagagaataattttatagaaataggcaaggcaaatattacaaatagcagaacttattcagaaacatgggcaaatgggataacatcaatgaaagttggagatactcatggtgtttttggtgatacaaacatctcaaaattaaatggtaaatatgatctcatggccgaaaaatatcaaggaaatacggtttatctcgaattttattatgaccgaaacctcattgccaaacctgaagttctgattcagggataaaaaaattatttttttcccacagcaaccagtccatatgggtgagcgataacctgtacccaggtaaaaccgatatcctgtaacaggatctctaactcctcttttgtatacgctgcctgaactgaggtttgaaacccttttttgatctccggccccttacaactatcgagcatgaactggtagatctctggtgacagatcccttcggagatcactcacacgtaactccccgcctggttttaagaccctgaatatctctgaaaaaacctttcccggatcttcccattcatgcagggatccgtttgaaaacgcaagatcaaatgaattatctgcaaatggcatagagagggcatttccttcatgatagattgaacggtcagaaagaccataatccttgctgttcttctctgccatacgaatcatggcaggacttatctcaaggccggtcaggtgagttttttttgtatgtttcagccattctagaccaaagtacccgggtccaggaccaatttcaagagcactatctcctggttttgacgcccggatcagttcctcaaccgggagatgcccgttatcccgaagccctctttgcatatggtcatactgctctacggtaatttcatcttgtattccttctgatgtttctggtattctgggttttaatgtcatttgttcctcttttatgtctgtttcatgtgaatgtgcatatcgtccatcaacaacttcttccaacctgagcagtctgccgtttcgtctttggatgagcgagatccgattctgacttcctgtttcccggaatgttctcagtgatgaggtgaaactggcagtatcatgtacgcctgaaaaccgtgtacagaggtcagcaaactgtttttgttcatcaggtgtcaacctggaaagaccggattcgagaaatccatagatcttttcttcagtagaaaggatccattcctcacctttttcagtaggtatcacctgaatactccgtctgttctctgtatcaggaacgcgtctaacatacccctcccgctcaagataattgaccaggtctgtagcagagctgggggatatctcaagcattccggcaatatctcccatacaaatcctggagaaatatgatgagtagagtatctcaatggctcccgggctgagaaggttttttctccctttatttgttccaaagatcatactcatgaccgttgaaacaaatcccagggagagccgtaatctggatgtcggatccatgtgctacataattaggatatccgtaatgatataaatattacggatggccttaatgagtatctgaaatcacatgatgaagttctcatactcacatggaattataaaattttcatgaaaacattggaatattacaagatccatatgatacaaaacaggagagtcatatgtgtgagtttaccgtttatgtaaagacagcagattcagaagagcaggagaagattacccggaatatcgtaggtgcaataaaaagggaaacctcagttactctcatggatgttatgggtaattctcaagtcgttgagaacgcgtacatagaatcggtgagcacgatgaaacaggagttgatactccggaaaatgagttagacatccggtcgttttgggtgttatccttttccgaaaaaaaattatggggctgttaacagccatttccaaattgggataactgatattctaatatcaggaatatcaaataactcttcgtcttcaaaagtcaggataagtccctttttcacattgaatttttccattgcgagggtaagcccttttatctccctgtccagagttttttgatcactaagtgaataggatacctgaattgcttcttctactacctgattctttttaacaagaaaatcacattctccagagccagagtaaaagtatacttcctgatatcttcggagcagctccaggaatatgagattttctattctttgacccagatcttcggacagatgaaatcctgctgattggataaaactaagatcccctgcatagattttatgtgatgccctgctggttgctttgagtgaataatgaagaggcgcaatccggaagagaagaaatgcctgctccagataatcaagataattctttatcgtgcttacacttttaaggccggtaatatcagcaagttttttgtatgatatcatcctgccagcattggaaatcagatacactgtcagatccttcaattccttgatctcacgaattccaaatctgctcacaatatctctgtatatgatatctgtcaggtactgctcggaaagagcgatatcaccagaacggataactgcaggaaatcctccctcttccaggtattttctaagatagcggattatttctcccttctgtgttgatgaaacgaattcaggattctcacaggatatggagtaatatcgaaggtattccctgaatgaaaatggatggaccctgattgttttgtgtcgtccggtaagatatgtactcagttcagagctgagaaccgatgcatttgatccagtcacaatggttttgatcttaaaagtatggagattgttaagccagcgttcccaaccgtggatattctggatctcatccaaaagtaggatcacgtgtgcatcaggtccaaagagttcgcccaaaatttcataaatatgctgaaagttttcttgattaaaatctgaaaacctgatatcatcaaaattaatataaagaaacttgccatcaagtatttttgacaactgggtaaggattgtactcttaccacacctgcgaatcccggataatacgatgatttcttctgactgaaggagtgattcaagaggaatgtctcgggggacatactgttcatcaaagtccaggattttttgttgatcaatgatggtttgtctcagggcacttttgagcacaattatgatatgttattttctgattatttattcgtttgtaacgaacagagatcatcgggacataacccctggaccatctctccattttcagtcaactatctcaattgtgacatttgttagaaattttcaccctgcaaaacctttttgcgaccttatcccttagtatgtattattgaaacaagaaaacccccttatctatctgaataacgctgcaaccagctggccaaaaccgccggaagttattcaggccgttcaggaatcattggaattacccttcggtgggggaggaaggggaactggcagagcacagagggattatctgaccgaaggtcgggaaacggtagcacaattttttggtaaagattctccggatacaatcgtcttctcgttgaatgcaaccgatgccttaaacactctcattcatgggtttgctgcatcacagaccgaaaaattccatgtgattacaaccgcccttgaacataactctgtgctccggcctcttcattatctggaaaaaacagggatgatttatctggattatatccctttttccaatgcacaggtaaatcctgagtccatcattgaagcggtgaccgataaaacccatctggtggtaatgaatcatggaagcaatgtccttggatcggtgcaggacatccgtgcggttggggagtatctgcatgataaaggaattttctttattgttgacggatcacaaaccgccgtacatatttccctgaatctctcctctctcgaactagatgcctttgtgtttaccgggcataaaggtctctttggaatgcccggtattggcgggttctgtattcgaaatcctgatccggttcttccggttcggatggggggaactggtactaattccaaatcccttgatcaaccgggtgatctgccggagcggtatgagattggaactcacaactatccgggagttgcatcgctgattgcaggtatctccttcctccagacaatcgggatggataccctgcaaagaaaagcagatcgtcagattgaatatttcatgaaggaactctcatccgaaccagggattaccatctataatcctgagcctgatcttccgattattgcgtgtaacattgccggacttgataatgatgatgtggggtatattcttgccaggaaagataatatcgttgtcagaaccggtcttcattgtgctccactgctgcataatgcaatagatgatggagccggatgtgtacgaatcagtccttcatggtttacgactgatgaagaatgccagatagccgctgatgctataaaggagattgcccaccatgcggattctcagatctaatcgccataaatattgtgctgacggttcgtttatgaaagaattcatccttgatacagaagttactcctgaatttctggatttaaccatcgtgatgccgctctcatggagcgtgtgaaaacccggttatatggtaattcatcctgatttcatgtctttttccgtctttgaagagtatgctgatgagtatgatcagtggtttttagataatcgcgatgtttatctggaggaattaaaacggatcagggaggctataggggatatcccttctccggctcttgagatcggggttggcagcggacggttttcagagccgcttggtatcaggcatggtattgaaccatcccgtgctcttggtttgatggcgaaagagagaggaattgaggttatccgtgctgtgggagaagcagttccgatgaagcctggaataatctggatggtcgtgatgattaccgttctctgttttctaaaaaaacctgaggagaccttccgggaggtccatcggattctcatacataatggggaccttctggttgcatgtattgaaaaaggtgggattattgcagagcgatatctggcccgtccggataaggggaggtttctttcgcatgcccggttttatgagcatgatgaggtgattcacatgatcactgggactgggtttgatatcacatcaatcgattgcagattgggattttgtatcctgaaatttaataagcgtgacaaagtctgaaaaactgattttgcatcagccgtttatccccaaatcggatcatcaccaaaatgttccttccagtattccattgatcgggaaatatgccgtttattgttcccttcatcggtaaatgtgacctggtaattcatacagtaatcaacaaggatctcatatgcttctttataccgtatcatcatctcatgggattcatcaggttcatgtgctgatacatccgggtgccattccctgactaattcatgatatcttttcctgatttccatcaggctggctttattagaaaatcccagtaattttgcggcttgttgtatagaaatctccggtgtcgttatcataatgaggggctctcaggatattaggtgactgagagtaataatgatgcataattattgcattgtatctttagagaaaatttttgattgcatcatctccagaagttcagccgggtttgatatcttatgtgcaccggctgacaaaagcctttttatggtttcggttgcaaccccgcttgtaaaatccggaagaaatggttctgacgaagggagaatgcaaattatcttttttggatcaatctgttcaagaaccctgatatttggataattcccccacccgaccggcattgatgttacgatgacaacatcagctttttgtacttgttcggtcagtttttcttccatttccagggagagacgggaaaaaggtggttctgcaagagttggaacctcatattttcttgccatcatgcagtctgaatcattttctgtcaatactccgcaactgagtgaatatccggatctgctcattagtgagatcaggtatgatcccgttcctccccctgaaatcaggtgaaccctgggtttgtgcacttctgactctttccactcctcctctacatatacaaagggtgttccggttatgggattgatatcaataactggtcttatcctgaatacctcatggatgagttcgctggtcaggacttcctccggttttccacatgcccgtatcctgccgtcatgcatgagtaccaggtgatcgcagtatgccgcagcaaggttgatatcatgaaaaaccccgattactgctcttttatccctggatgtctcacgaataatccggatgagttcatactggtgatgaatatcaatatgggcgaagggttcatcgagcagaaggagaattggatcctgtgcaagcacccgtgcgatcatgacccgttgccgttctcctccggagagtgcggtaattggtcggtctgcaagttcgagggtcccggtctgcgcaagagctcttctgactgcctcatgatcttcttctgatggagaacgaaatcgctcgatatgtggattcctgcccatcataaccacatcataaaccggatatttgaattttatttccgattcctgtggtacatagcccactttcatcccaaaatcacgaaatgaataggattgaagggaatcacccagaagcataatgtccccttccctgaccggaagtgatcgggcaagcacctgcataaacgtactttttcctgagccgttcggtcctatgattccaataaaacttttctccctgacgagcagtgagatctcatgaagaatatcattctcatcataaccggtagagagatctgatatttcgaggatctgtccagtcataaatctgatctccgtctgatgagcatgaggaagaatggtgccccaaaaaatgcggtaacaattccaaccggcagatctccaagccatgtccgggagatagtgtctgcacagaccaacaggagtgctccacatcccagcgatgcaggaattaggacccggtgatccggacctgtgatgatacgcataatatggggagatacaagtccgataaacccgattgatccggatactgaaactaccaggccggtgattcctgctgataccgcaaggagaaggagttttgttttctctggatcaataccgagagttcgtgtctctgcctctccacaagacatgatgttcaggtcacgggaaaaaagtgcaagtatcccggcagggatgagcgttatgagaaggagaggaatatctgcccatgaagcattccacagccctcccatcagccagaacattatctggtgcatgttctttccggaaaataccagacatacagaaaccaccgacgagaaaaacatggaaaccgcgatcccggtaaggagaagatttcctgtactgagtcgtctcttttgtgctgccagaagatacacgagaaatgccgaacctattgcgccgcaaaatgctgcaatcggtaccagcaaaacagcaccggtgattatggcaagagatacaccaaccgccccacctgctgatgttccaagtgtatacggatcagcaagatcattgcggaataatgtctgcatggctgctcctgcacaggcaagtccggcacctacaagcgacgctgcgatagcccttggcaggcggatatcaaaaaggatctgcgaatgcgtagtatcctgcattataccggtcagaatttctatcaatgatatttcaaccgggccggtgatgacagatagcaggatcgctataatcaccgtacaaaagagtccgataagtattagaaaatttcgaatggtattcatatgatgagtgggaaattattaaattaatttttacttaatgtaagataagtgattgtgttatgatgaagagaaaatccgaatctgatatgagatcgaattatcgtttgaaatggctgaaagcggcgatttattgtataatattcatatctcttctgtgttctcctctttcaggtactcttcaggaagggaattctgatccatggccgcggacaattcaggatgatcaacagcaatcagtactggtatcttctgaacctcaacgaatcgtctcccttgccccatcgaataccgaagttctttttgcccttggacttggtgaccggatcgtcggagtcaccgatttttgtaattatccggcagaagcattagaaaaaagtaaaataggcggattttctacggtgagtatcgagagagtcgttgcattacaccctgaccttgttattgcctctccaggaaataaccaggaagcggttgatcggatcaaagaccttggtattccggtttattttgcagatgcccagaaccttgctggtatatatgccacttttgaaaaactgggatacataaccggaacatctgataaggcatcggaaataattgctgaactgaaagccagggaagaaaaagtccggaaagagggagaagcctttacgaaaaaaccggttattgcccatgttatctggtatgatccgatctacgtaagtgggaaagggacattccaggatgaacttattcagattgccgggggagtgaatgccttttcagataagaacagtcatgcaatcgcaaatattgaggaatttatcagtaagaaaccggatattatcatggtaaactcaggaagtggaatgggaagtgataagacagatattttagattatttcgtaaatgagcctcgattatccgggttgtcagcaattacttcaaataagaccatcatggttaatagtgatattgcagatcgtgccgggccgcgtctgtgggatctgttagaggagattgccccgaaaatcagggaattgtaacttctatactcctttttagagtatttttctgagccataatcttttcctgaaattcatctcttgatctactggtaaattcatgcaccaggtagtcagggttaattatctcaattatttttttacaccatggatctgaaaaaggccggtgttcatcaagtttagcaaccatgggcatgagcagagaaatttgatccccatatgagagactcgaaaaaccggatgggggttccctgaaaaagtgttctctttgatatgctccggaggtgctacattggaaatgaactgatcgaatccgtcttatcgttctctcagataacccatcaagagctgatataacatatacaattccatcctgttcagtccggatatctccagcattcatcatatgtccggtatcaaggacaaagatccagttattaaattcaagttgctccgtaaaaaaatccacttcagcctgtgataagaacgtcagcccaggccaccagaggttttcaaatccaatagtcaccgggggctcaccacctggataattcctacagacggcatttaaaaatgaggcagcagaggagaggacttcgtgataggaatatcggtggttccgggtaaaaaattcgtcaagttcaatatgggtgatatgaaacaccgcatatactgcacccagttttccggctttttccaggttatcacaaaatgtccggatgagtgtatccggcgttgcagctccataatagtatgcctgtttgaatggatcacatttcgcaggaactgattcaggttcccgccagaggcgtacccatccaagccagccgggaaggtgaaccgatgatatgagatcccttgggattgtttcgtcatattctccccccatcaggagttcaacacctgaacattccatatcctttacaaatctcctgacttcttcccaggagttgttataccgttccaaatcaacggaatatccagatatattgataatttctttcatgttcttataatcgttcagtcattttcttcaatcacaccatgaatctcctgtacatcaataacagatcctttccccgaatattcaagattcctattataaatattcctaccatattttttgaaaataaccccaaaatagaggtttaattttagagatttccagatgtccgaataacgggcatattaacgttcatttcgaaaattataagaaaattacgatttactgtggccctatattagtgagcatatatatccctttggtagatatgatctgacatataatttgggcattatgacctttggtacagtctgcatatgggaaaaggatgggtggaatttcagggggtaaaaaattgacaaaaattttgtgatatcatcttctatgtcccttcaatgcagaatgacagcagattatggggtctccccaactctctcgcaataaaagaacctggcgaaaatacgtattttatatataacctcacctcccgaaaacctttaggcgcatagacttaatgcagtcaaaatttctctatttttcttactgacttcagattgaataatctctccctgagatagtacaaaaagtttgatcttttcaagttcgagaagtagtttttcgacagaatattgttttgaaaggcccgtttccttcaaaatcatttgtaatctcattctaatgataagggctataaaaaccatgaacaaataacccctcaccgtatcttctcttcttgcattaagaggtaaagtgtccaaatcgttcttcattcttaagaaacacttctcaactgcatctctctcacgataaagggtgagacaggaaagccagtctaattcgccgttgtaaaaaagaataaatcgtcctaggcgatttattctttgagtaactgctttctgtcttattgaaacctcgaatgttccgtctgtaaatttccatttcaggtaacgtgcaaaccctttcgcgatttcattcaccactacttcaggtcttttccaactttgtggtcttgctttcttcaatctatcagccgcgtcgaataattgtacataaaaagaatctctttcatcctgttctctttttgggtcataatagcaatagccatcaacagtaattgttcgaggtttatcatcgatctctaattgatgctctaatttcactggcattgcaaatataggacctttctccaatttctgaagatattcagcttgttttaccttattttgagatttactcattaattctttaattgacgtgagttgataggtcgcaggcagaataaaagggatattctcgctcaaaagttcagccaatgtggtttgggaaaagaaacctctatccattactagtctaaattgttctgaaccagcatctctcaatcgtatgatggtatttttcaacgtagtgatgtcggcaatacttcctggatatatatcataacggacgggaatacctttttccttatccactaccagtgaaaaattaatctgaggaaggccatcattatcccgattgtatccatattctaggctctctaaaagtttagatgaactggataaactggtaatgtcatagagaagagttgcatttggttcaatttgagcagcgaatcgtctcataaactcttcagggatgtttttttgaccaaggtttgccaagaattcacttattctttggctagatagaggcaatttattgttatttagccatagtgaagatccttcataccacacctgaacatttgtcatcgccgttgggcgaagaattcggttgtaaacgagagttaataatgtatccgtttctgattctgaaagaaattcttccagtgttgcctgtattgaaagctcttgggtaatactttgaagtggtagcagattcccgtgattatatgcgaattttggggcagaagaaactaccattcgtgcaggaatcatttcactcgttcgaaccttaacaggttgcccatctatgttttttccgaggtactttgatttatgccggatctgctttttttctttatcatagtaaggagtatcttcgtaccagtactcaatcccattaatttttttgatacgttttttaacctgcatttctgttactaatttataagcacataaaatatttaaatgtaactgttaaaaagtttaaaaatagggttatttatcaaaattattctaaaacaaagtaaaaattagacttaaaacaagttttcttatgcgcctatgatccagtagatgaggatataaggctataatgtcacaatggattggttcatctggtcaccgcggtcatgcagtcatgaaattagatacttgatttcgtgttgaagtgactatgagcggtggtcgtgggtatgcagtccaaaacttaaatttttattcgtgatattattacactgataaaaatcctagatttttatggaactacgttcatttcaccaatatgtgagtttgttgttttttagatcaggttcacaatgaaaaaacccggtcaatattggaaggatgatctgatatggaaaaagatactattttacttcgtatatcatatattattagtgaatacttaatacctaggagagtatggttcaataaggtgattatcataactagtcagacaaaaatttcagaaggttactcgacagttctccctgctgaaatcagaaaaacactaaccctaactcccggggatattctccaatggtatattgacaataatacagaggctgttgcataaccaaaatgtcatttccgcaagaggacaatttccattcgattggaacttaaatcgtcgaaaaaaaactgggtttttcctcattgtactaactgtttgaagttatgcaacagcctctacaattataattaaaccaagaaagagggtgacactatctgatattttggttctataagctctggaggggatgctgtagaagataaaaagaaaaatcaatgtggtgagaaatgatttttgttgattcatctttttttttgtcgcacttgttgattcaaaggatcaatggcttaaaaaggcaaaagatctcctgcctgttcttgcagatgacaatatgcttatttcagatcttatcatagttgaatcggtatccataataggaaaaagaagtggaggaaaagcaggagagtaactattcaattatttttactgataattgccatactgttcatttaggagaaaaaaccctaaaataaggcatatttgagtttttaaagtacgatgggactctttcagtcccagatgctgtatcagttttcataatgaaaatacaacatcttgataaaatagtctcatttgattcatatttcgataaagctgatggaattataagaatttgtggttaatgtgtcgctaagaatatacaaagcaggtttacgatagaagccagtatttagataaatacagttattctgacatattgaggtgtaatagcttcaatttttcgaaagaaaaagatgatgcagttgttctggtatccccaaccgctaaaggatgggccgaacctgctctctggcaattgcagatgatcctggacgatatctgtcctggtggtcagatcaacatagaaacagtgaatggttatcaggatttttagaaagtaaaaacccgcttgacatatatcggggcacataaggacaaactggtgtcactcaccattgttccgggtattcatgcatggatagaatattcaggcgatgttaaaaatcagtcatggcagaaaaagtttgaatccaattgtatatctgtcacggttgaagccaaaggattgggagaatataatctggtcatagaattgttcatgtacctgcgtcgaatagccaggttaggttaccctaacccagccttccaagaacggaccgtgcgattttcaccgcaatccgctcaagtttttcactacccgcttttatgggcgtagtgaaggaacatccgtatcgatctttgctttgagaggaaaactcctggcctgttttcaaaatactcggtatcaataaacggatttgcatccagttttatgaattttcggtattgaattttggtgttggagaagttttcgagagtaagagtagaggttctaaagacctgttttctggtaagtgttgggtgccagtattttctggcaatccatctcttccctttattattatgacggcgctttgcccatctccacaacatatttcggacaacccagtcaagtttcccaaaggtcatacttgcagaaaccgtccggtgatacattgcccatcccttaattacgggatttagggctttgataaggtcttcctgtttccaggccttcgccgacttaatgattacccttactttatcaatgattgcggcaatagctttcttcgaaggttgtatcaggaatttgcctttgaattttctgaatttcagcccaggaaatcgaacccctcgttgatatgaacgattttggtcttttcctcagagagttcaagccctcgttcatgaagaaattcagtgatgagttccttgcactggagtgccgtttcctgtgagtctgccgttacgagaaaatcatctgcaaaccgtatgagatgaaccttatttccgggaaagtgttctttcaacattctttccatgccgtcaagagccatgttagccaataagggggaaattaagccgccttggggcgtacctgacttgttacggtagagtattccatcataaatataaccggctttcaggaattggttaaggattctttggtcaagagggatgttatcaagcatccattggtgtgcgaaattatcgaagcacccttttatgtcaccttctaatatccattggcccgaagtctttctgcttaagcactgaaaagtgtatgaagcagcatcctgtgcatttcgcttcattcggaatccgaatgatgtcttgtctgctgtggtctcagcccaaggcataagagccattgcatacaaagcttgcatagcacggtcatacatggttggaatcgaaagaggtcgcattttactcgattgcggtttagggatgtagattctccggagaggttttgcccgatagcccttgtccgaaagcgttaatgctgctttcattttctgttcaggggtggtccatttttccccatctactcctgcacttcttttacctctgtttttggttactcgttgtactgccaacatttttgcataaaacgaatgtgtaagcagatactggagtcgtcttgcaagtcgacattggccgttcttcactgcttttgcgatacgtgtctgaagtcgctttacataatctcttgctttagcaaatggaaatttcttccattgttttgcaagttttctgtccgagatgtcctcgcttttatgcgtaattgaacttatcccgttcattgaaaccatcctgttcgccgtgaaaaaccagctgcacgtcggcaccctttcaggtcagggcaaagtttgaacccctatccacagccattacagccgggcattcgcgttttgcagcctcctactcccactacgcatgtggttcctctcacaaggttcttacctaaaaaaatttttttttttttttttttaggagcgtattgggttttccaagttcaataaatcggataattgtggtattttaggacccgcccatagaccggaatcagcttcgtccattcgtaccagcataattcaagctactgataccgtgattctccctcagtggggacaggggcaaatctctttcctcctgatataattaacgatcctgcagcggttcaacgtttgtttgtccatgatacctttccctggcagcttatcccaaagagactatgggaatcaccacgttgttcctgcagcttcgcacccgtttattgctaaacacgcacgtgcaggtagggacgcccagaatggattgggtggcgttcccgattttaaaccgggttcgcaatccgatttactgcttcttgtcgcactggatcgttttacttcttcaattgattgatgccgctggatggcatgtatggtaacatgagcaagttcacggaactgatcagatcctccacctttatggagatagtgatctgcaccccagttcagggcttctaccgctatctcttccctgcttttcccggtaaaaagaataaatggagttttgtcaccagttgatcgaagattgataagaaaggtaatgccatttgatccaggcatatcaaaatctgaaataattgcatcatatttcttttcctgatgcattatcagaccggtatcaggatcttcagccaggtctatggagaattcaccaaatttagggagaaataagctgatgagatcccgaattattggttcatcatcaacatacaagatagaatacatgaaaatcagatctgaaaccgagaaagatttaataaagcatttggttcaaaagcaataaaaaaactaaagtattccggattttttatgagtatctgttttagaagttccgtagcatcatcacgtgagagttgatggttttgataattagctgaaaaatatgtcgaaagcatgttagcgcagaggagcccttcacttattttttccttgattatggttaattccatagtattttgggtgaccagtagttcctctgcagattgtgcagcaagggctgataaactgaaccatgagaatacaatcacacataatccgataagaatcatacaacatgttgatgatattgcaatctttttttggatggtatttaatcgaaatataggcatttctattctcctgaaaaaattatgccccattaagtaaatttatatttactttgatacaaaatatttgttttaatgggttaatagcctgttgatccaggcatatatgttgggaaaatagtgttaataatactaactaaatattaaaaattttcaatacgtaataatattgttcgaattcctcgcgtaatcacttttaaactcgagaaatattattcttcattgtattcattgacatagcttattccctgatataatttggaatggcatttcggattttttgaagaggatatctatatgttacaatggtgattaagattaaaaaatataatctcatattttctataccaggtaagggggtatgacacgtgtgtaactcaaatatttttcttgatgttcaaattaataaaatgggtctttttttttaaaataaagtcgaatttgctaatttgagattgactgcttttttaaataataaagggagttcaaatagggtttataatggctaaaaattgtacgaaattagatttttaaatgcccgctattgtggggatgattaggatcatggtttgatatgaatcagacaagatttagaaatagtggctcgtggtacaaacattttgggggcaaatatccggcacaaaaaaaggcacgggtatttgataaaaagtatgttatctcgtatacgtgccctttagtgagttaataggggcgattaggatccggggatgagatgatcgttcatgtgtgccatgttaattgaattaaggattggaaattactggcatttaagattttttcagcgatcaaggaagaattcctgagtttttgattgaatgaataaggatatgtggtgcagttattttttgtaaaattgaatggtcaagtcttacatatcactaactatttaagttcaattttaaataataatttaataaatttaaatgccttctctacaaattacaaataatgcgtattttatcgcaaatttattgtaatagcgagtatattaaaattatttttaattatatataaatttaacaaaataaataattttataagtaaataattacacacaattatgtgcttataaatttatggagtggcataatgaaaggtcatggcaagaaaattgagagtcatggagcagtgttacttgtctccatcggaacgacccaggcggaagggagagcagttattgatacctgtataaagaagatacagaaagaatatccaaaagcagaggttgcgtattcattcacatccgaaccggtcagacttgtcctgcgggaacagaatgaatatattctgggacctctggcggcgattacatctcttctggataaaggtcattcacaggttgttgtgcagccattattcattacatccggggcacgatatcatgagttatatccgattatcactgccctcaatgaactagccggagcacatggagcagtgggttttgacgggatacttatcagttcctcactgctcatgaacccggaggattatgttgacacggctcaggcaatcgagtcaatttactcaattaaggcaaaagatgaggcagttgttctggtatctccaacggcagaagggggagctgaacctgcattatgccaactgcagatgattctggatgatatctgtccaggtggtcagattattattggaacagtgaatggttatccggattttgagaaagtgaaaaaacgtctgtcccatatcggagcaaagaaagttaaactggttccactcaccatcgttccgggaattcatgcatggatagaactttccggcaatgcaaatacccagtcgtggcagaagcagttagaatccattggttgttctgtcacagttgaaaccaaaggattaggagaatatgatcaggtcattgaactgttcatgaatcggctgaaaagaacggctgaatcacataatttccttaaataaccttttttctgtaattcatttgggtacgatcccaaagatcatacctgtaccccatcatgctctgccgtttcagttagaatcttctcatcccagattttctcttcctcccgatcttacatgagcaagtagatctcattagccccgcattaattagtagatccagaaatcgggctacatttcctggtaattattgctttgcgtaatcctctcaaattattgcattcaataacaaaccacagaattgttccatccggaagagacaattgaataaaaacatcagacaggcctatccttaagtcatattccctggttatctgttcgcctgtgttaattattcactgaaaaggggtctgatagagaagtgagagtcatttttttgtaaatggcgttctagggttatttttttgtttttctctaaaaatctaacaaaaaaaggggaataattgctttattgtaaaacaaaagatccctgttgcatgaccttgtcgctggccttatcaatgagtttatactcacacttggtgttcaggtatgctgcaaaaccacctgctgcaccatctggtttccaggatatcacggaaccactggaatcaatacggcagtcatctgcataaaccatgaacttatctccgggttttatgaatccatcatcgtctccaatttccataatatacttatctacagatggtggaagacaggtagtacttgggattttgtcacttaaatcaataattgtttttgtgtcacctgattgaatctggagggcaacatctgcaagagcaaaagattctccacccttatgttcaaattccaaaccatttgcggacacaaatccggatggatgatctgcttgatagttggttttatctgtatcggaaatattttggataatcccttttactccaagagagatctgaggggctttggattgatctgaagctaatgatccggcaaatccactgactactgcagcgatgataatcgttactaccagcatcaggagaatgccaacaaccggtgaaaccgcttcatcttttcttacagcgatcattttaccacaacctccttggaatagatagttttttgactgggagtatgaagaatgtttacctgaacggttgcccctggtttaaagtccgcatcatcaatagtatcaggatccggatccgtccctgcagtccaatcaaggccgaggaattctgcaacctgccgggtagatcctgcagaaaggatgtcaccagttgaaatggtgtagttaccaaaatctgctttatcattatttccagcatatccaacctttgaaatgtcattgagatatggtaaccgtgtataacttgttccatatccatataaatcaaatttttcactggtggcggagtgagaagtcttgtaaatatgacccgtgctattggtaaagtaggtaataatttcaagatctttggtgggtataggatctccactcagcatttcgaatgtcatttggcttgttgttcctcccatcccattacttgcagatgtatcaatctttacatccatggacaccgatggagctgccttggcatctccggccagccccccggcaaacccactcaccacagcagcaacgataatcgtcaccacaagcattaacagaacaccgatcacaggcgatactgccggatccgttctgcctttatttattttcatcattgtcacacgctcaaatatttttgtgctaagtaaaaaaattcttagcaaaaaaagaatgatggttctacattaatatacatttctttcatatgtgggcaccctaattagaatctaaaggcattcaatgcaatctttttactatcccggtaataccatagaaaacacgcatcataagggaacattgtaatatccaggaagaaactatttgtggagaatcaggatcaatctctcataaaacgcatcaacatataattttatcaatagagggtgttgcaccaatgatcaatatcatgcaggatcacaaatgatcgatctctaccccttaagctatcaaccaaaatagactaatggatgtatgaacctgcatgtatcaattcccactttacatactgtgtttgcaaaaatataggaaaaacctgaacctcttgacggttttataatattcgtagcaaattctttaattttaactataccctcaaatctgataagtttttttatattatgcactaatgcagctaaaaagaattctccctcgcaattctctttccctttttgagagaaactcctaaacctcatattatgtttcatattaccaaaaactggttcgaccatgtattttcgttttcgatataactctctaccagtgggggatttcacacgtacttccataactcgtttacaaatttcctgagttgttgcttgtttctctctgttcataaaagattgccaaacaaacgtcccgatactttgcaattccggaaatgtgattatttctcccatacaaatcgcccgacatatcatttccattcgtgagatatacccatcattatctgaatattctggaatttttctttctttagaaggagggatgatgagttgaatgccataatccaattctgctaaagaattcgggtatgagaaataacctgcatcagatagtagtatattaggcgaaattgatggatgaatacccgtaaaaaggtcttcgagttcatttagcataggtattaataattttttatcgttttgctcatctgatatcattgcagcgaggataaattgattttcagaaacgataatctgcccattatacccttgaatccagccattggtggttgacattatctgactttcaggatcagtgagatttacttttgaatctgaagatggctcttttttaggctctaaaggctttctacctcgtttctttttacccgattctaattcttctttttcgcggtccagaatcttttcttcttgttttttagattcgatatcatgtcgttcaattaatttctctttagcccgattaagaacttcctttcgtttttcttttgttgaaagatgctcaggtagtcggttaatctccatatcctgaatatttatatcatcgttttctaactcatcaatttcctgtgattcatcaaaaagccgacctagctctgcttcaaggtattttaattttttattggctgataaagaggcattacagccaaattttgatccatcgagggctaggacaccgattcttgctatcccggattctacgataatttgagataattgtttaaaaagggatttgatttcttttgaattattcttcttgaaacgatagatcgttgtatggtcaggtgtaagattattggcgacaatccgatatccaatatcataatggcagcacatctcaatttttctgctagatttttctccacgaatcattgaataaattattattccaagcattgaacgaggatcaaaaaaggcagaaccgcgaccatcgtcacgatatttattaataaatggactaatatcgagaatcgaaagaatttctaatatgccataagtaatatcattttcagatagccagtccatcgcattgacagggagtaaaaattgttgttcattaccatatcctctaatcatgttatagcgatgagacatataatatattgatcttaataatatatataattaagctttaataatttatattaagctttttttgtgtttgtgcaacagcctcaataaccaaaaaaattgaatatagatacaccttcacaaaagagtctccaaataatgatggtactggattcgttcgtatgcatacctgattccaatctagaatctgaacttgtcaaagagaaaaaaccctcgaagccatgaaactattaatgatcagttctaactgccaaaaactggcatggacactttttttgctcttatgtaccatgatctgttctgccggttgtcttgatatgtccttccttgcccctcattcatccgatagttcagatacttctttgacagaggataaggacccagagcctacaattactccggccccggaagaaaatacagaatcggcattcccccctgacatgcccccacaaatacgggaaagactcatacgggagggaaaaatcccatctcctgtgcagaggcagataaccgaaacacaacagactatacacaatcctgtccccacgtcctatgtcattcagggtgcaggttccctctctgatgatgtgtttattccttcacgggaatcaatttatttttcgaataatacttcagggtccggacccggaaacctcaatccagtatatgcccaaacggacattccattaaactccaatataaaggaactgaaaatccatgccgaaaagggtcccttttctgtcagattcaccgtgcatccaaaaagtactcctcttgtttcctgggcaaaaattacagttctggatcctttccagaatatccttcatgaagatggatataatcgagaattcagcagtgagcaagtcaaagaatttgttgtatttagagaaggtaattttacggtcatgataagcggtggctatgcaacccttgacatcagtatcaacactccggacggacaggtccaaccccgggcatcagcaacgaagagcgggctggaaattcctgatgatatacctccacagctcagggaacggctgatgagggaggggaagctgtagaaaaaaccgttggtattagaataaggtattataaaatagagagcctgaaagagatttcaggcttcgtatgctacaaggacagctccgagtttcccttcaagatccttaatagccttgaggtcatctggtgtcaggttcttataatggggttctgcaagcaggtaaacaccaagctcgttctccaattgctgaattttttctagtttttgtccggtcaggtttgcaaacatcttgaccaccagcattgcataatacgcgtaagataataaaatatcgctgaaattatttaacgttaacaaaacatttgtttattaggtaatcctttctccgaaaattgcataacaaccctttttacaaatttcagatcaaatattttttacttttatacatctcacttgtataagatcgctggtcatttctttaccagatttaattgtaaataaaacctgatacggggagtatacattacgtatgtcagaacctgagccatctataaaactattccatacgacatcgaaccatgaagagatataccggacagaggatagcatatttatcaaacttccacccggacgggctgtcctctcgacatcatggataaacgggggataccaggaaggactaaggggagtattcaaccaccagcctccccatcatgcaacctgttcgcacagccttgaaggcggatcagtagaagcatacatggcaatagttgccggaagacttggattttcaccaaagaaaagtgccggacttctgaccgcggcaaagatgaaacatgctgcagtcgtaacccggtcattcaggggggtagaagttaccgcagttgtcaccgggggaatagaagtgaacggagggcgtgcaggagatccggcatcatacttccaggaaaacggaaatatagagatgatttccggcactatcaacacgcttcttctcattggcgcacacctcccggcatacgccatgacaaaggccgtaatgactgcaaccgaggcgaaagcagcagcgctacaggaactcatggcccagagcaaatattcttcaggaatagcaaccggttccgggacggatggaatcgcagttattgcagacacaactcatgaaaaacgacttactgatgcaggcaaacactcgaagctcggtgaacttattggaattgtggtaaaggaggcaacaactacagcgctccggagacagtctgagctttcagcagaaagccaggcagattgtatggtacggttaaaccggtttggagtgaaggaggatgacctctgggtttttgcaacaagattggatggagagaatcgaaaacctgcctttttccgttcacttcaacaggtagcacgagatcctgccattctcgccggagttactgctattattcatattatggatgagatcagctggggtctcctccctgagactgcaggaagaaacactgcgagaatttatcttaaggggattccggaaatgtgcggattaataccggatgaggaactccactcactcctccaaaatgaagactcggtaaaagaactccttcagaaaacacttgcatggataatcaaaaggaggattccggtataatgtctgaatcatacaattttccttttactgccattgttggtcaggaagcaatgaaacaggccctgctctataatattataatgccctccatagggggcgtacttatcaggggagagaaaggaacagcaaaatcaaccgcagtcagggcattggcatcactcctgcctgaacgaaaatgcgtaaaagggtgcccgttccgatgtaattttgatgaaccggataattattgctcactctgtagagggtgttgcaccaatgatcaatatcatgcaggatcacaaatgatcgatctctaccccttaagctatcaaccaaaatagactaattgatgtatgaacctgcatgtatcaattcccactttacatactgtgtttgcaaaaatataggaaaaacctgaacctcttgacggttttataatattcgtagcaaattctttaattttaactataccctcaaatctgataagtttttttatattatgcactaatgcagctaaaaagaattctccctcgcaattctctttccctttttgagagaaactcctaaacctcatattatgtttcatattaccaaaaactggttcgaccatgtattttcgttttcgatataactctctaccagtgggggatttcacacgtacttccataactcgtttacaaatttcctgagttgttgcttgtttctctctgttcataaaagattgccaaacaaacgtcccgatactttgcaattccggaaatgtgattatttctcccatacaaatcgcccgacatatcatttccattcgtgagatatacccatcattatctgaatattctggaatttttctttctttagaaggagggatgatgagttgaatgccataatccaattctgctaaagaattcgggtatgagaaataacctgcatcagatagtagtatattaggcgaaattgatggatgaatacccgtaaaaaggtcttcgagttcatttagcataggtattaataattttttatcgttttgctcatctgatatcattgcagcgaggataaattgattttcagaaacgataatctgcccattatacccttgaatccagccattggtggttgacattatctgactttcaggatcagtgagatttacttttgaatctgaagatggctcttttttaggctctaaaggctttctacctcgtttctttttacccgattctaattcttctttttcgcggtccagaatcttttcttcttgttttttagattcgatatcatgtcgttcaattaatttctctttagcccgattaagaacttcctttcgtttttcttttgttgaaagatgctcaggtagtcggttaatctccatatcctgaatatttatatcatcgttttctaactcatcaatttcctgtgattcatcaaaaagccgacctagctctgcttcaaggtattttaattttttattggctgataaagaggcattacagccaaattttgatccatcgagggctaggacaccgattcttgctatcccggattctacgataatttgagataattgtttaaaaagggatttgatttcttttgaattattcttcttgaaacgatagatcgttgtatggtcaggtgtaagattattggcgacgatccgatatccaatatcataatggcagcacatctcaatttttctgctagatttttctccacgaatcattgaataaattattattccaagcattgaacgaggatcaaaaaaggcagaaccgcgaccatcgtcacgatatttattaataaatggactaatctcaccgttcgctgatcttaaattcagattcctgaattgatcccaattgagtataaacactaatatcaacattcatcagatttaaaatctctcgatgcttttgatttatcccagtaattgtgtaaaaaacctgttcaccataaaatgaaactaacaaataaatctctttgaaaaactcaataattctttcagttttaggattatttactattttcgttggattatattcgaaaagaccactcaaaccctgacctctacttttcagcgaatccctgacttttttctcaataataacaagtggtctcattacaatagtcaaaaacttcactaaaccatcaattctgtcatctcgttgaataaacattggggcaagtgaaagtgcctttcccttcagccgatgaaattgatgctctatgatatactgatcacggtaagtcagaacaacatcttgcatcgataattcattttctggtttatttgttacatataccctccatcctgataattcctgcgcttgttgaagggcttgcaagttaatagttggtttaacctcaattctcgtcgattgttcaattctggcgggattgtttccgtattttcgttttggagtattactaatatgctcgatatactcaacttcgaataccgctgttaatcccttatctccaagaatagcatgtactttttcttttgcttcctcgattgttcggtaaattttctttccctttcctcttttattcattgaatttatctcaaagaaagctttttttacttgctcttcaagtgataatctgaatttatttgcatgagcaaatgattttgcgtagattagccgttcctcccaggttatgattttcccctcatattccattgaatgagatatttttttctcaaatccttcggctataatcgcatcgcttccatcatagtacgatcgtgaaacttgtgtgaaggaaagattagactcctgatgtgctatgattgcagaataaatttcctgagtaggatgagagacttctgataacgggcataaataaaagtcattattgatagtcgtatacaaacgagttgctatggcacccattttgcaatctcccacaaaaagtaatccagattgtcccgtagattttttcaccttttccattgcagggatatagagaggatcatcagcacaatttccagggactacactaacggtgaggggcaaacccagcacatcaagcactgaaagtacgatttttatttgagggagggaggcgtcatcttttgagttgccaaattgtattaatccgtttttatcgataattccattgctgtttactgttgtcatatcaagacggacgatgttttcatccgttaaaccatatatacgcagtgtagaacgatttaattcagattcaaatcggttccaaagttcattattgtgcaatagagataatatacgagccaaatggtcatcagtaaagcattttggactaaattgaaaaccaatcaatttttccagtaaattttttttggtagtaacccacttctccaagggacacatacgatgatcattttcggtcaggcagtagcagatccaaatggcaatcgtttcaccaatcggcaaacccacccagtttctgtgaggcgaatatacctcattcaaaattcgtatgatttgaagttcttttaatgtttcaaagatatatgggattccgccgatgtgttcaatttgatgtgtcggagcgatcatcccatatatatgtacacttctcagatataaagttaagctttataatttaacatttaccttataagatcagcgaaaggtaagctaatatcgagaatcgaaagaatttctaatatgccataagtaatatcattttcagatagccagtccatcgcattgacagggagtaaaaattgttgttcattaccatatcctctaatcatgttatagcgatgagacatataatatattgatcttaataatatatataattaagctttaataatttatattaagctttttttgtgtttgtgcaacagcctctgtaaagaacgtgtattgtccggggaagaactgatcccggatatggtccggatgagagttgttgagcttccattgagtgccactgaagatcgggtttccggaacactggatattgaacatgctatccggactggaaagagaaagtttcaaccgggaattcttgctgaagccaatggaaatattctctacgttgatgaagtaaatctgctcgaagaccatctggtggatctacttcttgatgcagcggcaatgggggtaaattacgtagaaagagaaggaatttcattttctcatccggcacggttccttcttgtggggactatgaaccctgaagagggtgacctccgtccccagctcctggaccggtttggccttgtggtggatgtaaccggtgaagaggatatgcaggtacgcaaagagatcatccggagaagactggcctttgaacataatccaaaggaattcacccgttcttatcatgaatcagaaaaagcattacgggattgtgtgatgtctgcaaaacccatgactgaccggataccaatcgatgatacaattcttgacaaggttgtaactattagtctgcgactgggtgttgacggtcatcgggctgatctgacattgatacgtgctgctcttgcttcagcagctcttgcaggaagagcatccatttcccgggaagacattacccgggctgccggacttgccctccctcaccggatgtatcgcagacctttcgaggaacagtatagtaacatggaacaggtagaatcctggattgcggagctttatcaggatgtttcatgagcacgagtattttgctgatattaaaggacttaatgaagcaaaattatcacttcttctcttcctggtatcaccagttatcaggagtctgattcttattggtgggaccggtactggtaaatctcatcttgccaggctgaccaaatcagtaacagatgtgaaaaccgtacatctccctcaacatgcaacatgggaccgggtttttggctcaattgatatcacggcctcattagcacggggagaaaaagtaattgagcacggacttttaaaaaaggctgatggaggtattgttatcatggatgatattcatctcatggatcatactctcataaccgcagttctctctgcagcagaaaccggaatggtgaaaattgaaagagatggaatatcatcaggatatcagacaaattttaaaataatcgcgaccctgaatcaggatgaaggggaaatctctccacatataattgatcggttttccctctgtgctctatgcccggcaataaccgatccactgctccggaagcagtttcttgaaaaagccataataagaaatcctggtaattttattcccgattctaaatcctctgaaaaagaaaatcaacaaagagaacagattttacaagcccaacaccggtacccatatgtccaaattccggatgggataatggatctgatcaccagccttgctacagacctgggagttgagggtcatcgtggtgatattgctcattccagcgcagcatctgcccttgcagcgttgaacgaacgagatcaggtttcggttgatgatatttcagcaactctccaggtatctctccaacaccgaagacgagattaccagaaagagccacaatcttcacatgataccgataaaaataaatcatctccaccggaacccgagaataaaaaggacggcgatggattgccacaggataaccggcacgaagaaggggatcagaatgagtcacagcaaaaacaaatcccacaagctcctgctccggatcaggtctttacaataggcgatatacaattcacaaaagatctcatagttcaaaagaaaaacaaaaatttccattcaatggttaaaaccgggaaaaagggatcacatcagaaaatatctgatagcgggagatatttccggtcaaaaaatccttcaggaaaaatctacgatatcgcgtttgatgcgactttccgtgcagcggcaccacaccagattacccgatcaaatggaacgctcgccttgaatatatccgtacaggacattcgtgtaaaagaacggaaacgaaaatccgggcgtactataatctttgttgtcgattcaagtggttccatgggtgctgcaaaacgaatgagtgcagtcaagggagcagtcctctcattattgaaagatgcatatatcaaccgagaccaggtggctctcatttcattcagggggccgggagcagaagttctgttaaaacccacccgaagtggaatgactgcgtatcatcagctggcgcatcttccaaccggaggacaaacccccttatcctctggaatttacactacagtaagcctcatcagaactatcagacggaaaaattctcatgatgaaccgtttgtcataattatctctgatggcagggccaatcatgcacgatctgataatgatccggttgcagaagcatggatggctgcggcggctgcgagaaatgagaaagcacattactatgtcatagatactgaatgtggctacccccggtttttcctggcaaaaaaacttgctgaacatatcgggggaacatataccctgcttgatacgatgaacggagaagaaatcgttcagcttgtcagacaggagaggggtcgttaaaccaaatatcgatgaattaaataaaaaaatatttaactaaaataaagttacacatgtaaaggagaatttgatcatggtaagccatacagtctccttacaaagctcctgtattatctttgtgttatttttgctattgggatttctcatacctctgccggtgttggcagatgataaactccagaatgtggatcaggatcaggtacatccggaatatgcaaccggtttttctgttgaatatcatgagggctataaagttgtcacagttacaaaaccctggcgaggatctgatgaatcatatacatatgtcctcgtaaaaccgggagtgagccctcctcatcttggaaaaggagaagaaattataactattccatcagaacgatttgtttcactctcatcgacctatcttccatatcttcccatacttggaatcaccagttcattaaaaggagtcacgaatacgaataccgtgtatacgcctgaggttatgaatctcatacaggaggggaaagtaattgatgtctccggaggtgggtccggaatggcaacaggtatcaatcttgaaactttgatagacctgaaccctgatcttgtcatgacctatgcaaccggacaaccggagtatgatgcacacccaaaactccaggaagcaggtattccggttgttctgaatgctgaatacatggaagaagatcccctgggacgggcagaatggataaaattcatttcagtatttttcaaccgggaaaaagaagcgaatgcctactttgaaaagataaaaaatgaataccagtcacttgaaaaatctgttcatttcctcaatggtaccaatccgaccgtatttgtgaataataactggcaagggacctggaatatggctggaggccagagttatgttgctgaacttttaagagacgcaggagcagattatctctggtctgatgacacaactaccggaagcatccctcttgattttgaaatagtatatgataagggccagaatgcagactattggttaaatccgggtactgctatgactcttcaggaattattgggagaggacgccaggtattcagagtttacagctgtaaaatctaaaaagatttataacaataatgcccgagtaaatgccggaggagggaatgattactgggaatccggcgtggcacatcctgaaacagtattaaaggatttaattaaaatattccatccggaaatcgtgtcagatcataatctggtttactatcggcatctggaataaatgaaatatccaatatcaatgattctgtccgggcatttcaatatgagaattacaggaataatgatattccttcttctttcattaattatcctgttttttcttgaattagttctcggatcagttgcaatcccctatccagaaattgtccgtattcttactggtcagggttcctctcatgacagctggattatgatcatttacaatttccgcctgccaaaagcaatggttggtttatgtgcaggtgcatgtctcgcaatcgccggtctttttatgcagaccctttttcgaaatcctctggccggacctgatgttcttggtctttcagcaggagcaggtcttggggttgcaattgttgttctctcagcaggaacggctggagcctcttcaattcttggtaatcttggattcttcggaagtgttggtattgcaatagcagcatcttttggatcaggtcttgtactgttgatgatcctggcggtttcaaaaagagttcaaaacagtatgacgctccttattcttggactcatgtttgggtatactgcaaattctttcatttcgattctcatgcattttgcccttgcagagcgtatacaggcatataccatatggagttttggttcatttggtggagcgacatgggaccagatacaggttttggttttgtttgccgtattaggtctgatatattcgatatctctgataaaacatctgaatgtactccttctcggtgaccagtatgccgagagcatgggtcttgatcttatcagaacaagaaataaaattttcatcatcaccgcagttctctccggagtggtaacggcattttgcggacctattgggtttattggtatatctgtcccccatctctgccgtgcactctttgcgactgcaaatcattgcattcttattccggcatgtatcctgctgggggcctgtcttgctcttactgctgatattattgcatcagttccggggtattccattactcttccattaaatgccattacctcccttatcggggcaccagtagttatttggattattttttcaaaaagcaggaatgggatggaggtcagtgtctgatggggcttataaaaatagacaaacttaccatcggatacaaaaaaagaaagaatggagagagaaaagtcatctctcatcttaacctggatatgaaatccggtgagttaatatgtcttgtaggtccgaacggcagtggaaaatcaactcttttaaaaacaattactggccttctgccgccgttagacggtgaggtttttctttcgggcaggaatataagatcgatatcatctctggaacgggctaaactggtatctatggtactaacaaatccggtacaggctggacaactgacggtatatgatgtgtgcagtctgggaaggtatccacataccgactggatgggatcattggcacaggaagaccatgatatgataaccgcatctctggatgctattggaatcagacattttgcacaccggtatttacatgaactgtcagatggcgaacgacaaaaggtgatgattgcccgggctcttgcacaaaattcaaaactcataattctggatgaacctactgcctttcttgatatgccctaccggatagaaataatgcacattctcaaaaatcttgccatgaacgaagatcggggaattctcctttcaacacatgatctggatctcgcaatgcgaaccgcagatcgtctctgggtcgtcaatcatgatggttcttttcatgatggtgctcctgaggatttggttttaaatggaattatttcacaggtgtttgcaattggtgaaatctcctatgatgctgagcggggacattttcatatgcctgtccatcctaagggatcagcccggataactggagagaatgggaaattcagattctggacagaaagagccatggaaaggattggatatatctcacaggaaaatgaaccggcagagattcatgtacatatcgctcccacagaaagttgtataacgtggatcattaagactcccggtacagtgaaaaaattttccaacctgactgatggaatacattggatacaaaccttaaagctagttgtttaatttaattatttggcagtaatcaattttttacctactgatattggtgatatctgaataatgaaatataataacacggacggaccgatttctcgaattgcagtgtatggaaaaggaggaataggaaaatcgacaatatcagctaatatttctgcagctcttgcagatgaaggatattcagtcctacatataggttgtgatccaaaacatgattcaaccaggacacttctcggggaacttcatacgcacaccgtaaccgatttttttcgaacatcgaaaattcagactgattattcagacctcatccgaataggttataatggaattgcctgtatagaagccgggggtccagaacctggtgtaggttgtgcaggaaggggaattctgagtacatttgaaattctcaaacggatggagactgattcttcccggtatacctataccatctatgatgtcctgggtgatgtggtatgtggaggatttgctgtcccactccgacatggatatgcagatctcattctgattgtgacatctggcgaatatatgtcattgtatgcagcgaataatatccttcgtggcattcataacttcgatggcaatattaaacgaattggtgggataatatataattcccggggaggagcagaagaggatgaacaagtcagaaaattttccgttgcggtcagtctccctatccttgtaaagatccccagaagtgagatctttcttaccgcagaacggcattcaaagaccgttgttgctgcatttccaaatagccaggagacagtattatttcggaaactgatatctgaatttttttcaactaaaaatcctattcccaggtatcgtgcccaccctcttgaagtaatggaacttgagtcactgatactcggaagagatatatccggatatacctccccctctcatcaggtccctgtaaatttcaggcccataacaaatgacacagataatggaactgttcattgtacaatcccacaaaagccttctctttttggttgtgcatttgccggggcaatagccgtactctctcaaatccaggatgcttctattattgcccattgtccctcaagttgtgcacatattgtctcaaatcttctggtctcttcacaaaaccgggaccgtgataaatctgctgattatggtaaacagacgtcgttttcatttattcatactggaatggatgaaaaaatgatggtattcggggggatagaggggttaaaaaaaactattattaagtctgttgaatccggcaatcgtgtaatatttattgtatccggttgtacacccggtattaccggggatgatattgttggttgtgcatctgaaatgagccagaatctgggtattccgatcattcctgtatcggtcaacggaatcggagagggagatttcagtgctggcatcatggcagggtatcacgcctctttacaactggtgaaacaggaagccgggaaaaatgaacgttctgtgatccttgttggagaaaaaatacttgcaaataatactactgcaaattttaatgaattaagtcagtatctctctacccttgatatccaggtttcatgtaggtttcttgcatatacctctgtaaacgaagtgcaatccatgagtgaacagagtcttattctgccggtatcttctgataaaattaccctggaaatatctaaaattatttcagaaaaaaccggatcagaaatttttaaccatgcttttccgtataccttcaatgagacagtcagatggattcaggatcttgctgatagattcaggatccaggataaaggttcggctctgatcgcacgaaatgagaaaatataccgtaaagaaattgcattgattatgctgatgactgctggaaaacgggttattatcgcctcatctggtccggatatatcctgggttttagaggcggtcagagaatgtgggatggaaataatccgtgcaggatatttttcatctccgtatacgacgaaaaataatcaaaaagaatcagaaccatcaattgtaatggattatactcctgatgcactctatgatgatatcaaaacataccgcccggaccttgtattaaccactatctggcttgattataaaaaagctgacgtacggtatggaatgatccccttttgtccaaatgtgggattttttggagcattatcctcaatgaaacactgggcatctattctttcagggccggtaagagaaggatggaggaatgatctttgataactggagtaacagatcctgacatccttaccggaatgatactgggtgctgaggggattccagatattatggtgattttaaacagtccaaccggatgtaaattttatcatgggcatattgcacatctcaagaggaacgaatcggatatttctgatccatatcttcgtcctgagccatggtttttcggacaatcacggattccttgtacgtatcttgacgatagggattacatctttggaactcatgataaacttgaaaaaatcctgacctacataaaaacccggtggagcggccttatcgttcttatcaacgctcctggtgcttcactcataggagatgatctgaaaaaagtaatagccattatggagctggaggaaagatgtattccggttgaaatacctggatattcactatcagcaccaaccggagttgatcgaatgctggtcagaattctggaacatttaagaccttcaggaaaacccgataataaggtcaatcttatcggcttatcgattcttcagcgatattgtgaaggaacaaaaaaagaaatttcatatctccttgaaaaatcaggaatattcgttctttcaactccgggagcagggtcagacacagaaaacctcattgcatcatccggtgcgtccctcaatgccatagtgtttccagaatatgcaattgaaacagccaatttttatgcaaattcctataaaatccctttcattctgccaaaagatggagccccggtaggatttgatgctacaaagtcctggattaccgatatctgcagggctttcggaacagatcccatctttgtgaataaggagattcattctgccaaaaaaaccgctgcaagcaatattgcccgtgtaaatgcagtatccggaattccccgtggttcaggatttgccatacgagcggaaagttctcttgcacttcccctggtaaaatggctctatacgtaccttggtatgatcccggtcggaatagaacttactgatggctcatgccaggtatattctgatgaactcaggatctttcttcaggagaaccatcttattcagttcctgggaatctttcctggaaaagacccggatattgtttttactgatggagcaacaggaaatatgatgaaaaatcaaggcatttgcagaggatatattgatatttctcatccaccatctggaaaaatagaaataattcccaaaacaatctttggaatttccggatcactcatgcttatagaggaaatcttaaatattctgcgttgatatctttttttgaggatctgtcaaagattccaggttactctctatggataagtatatggattggagtaatctgagtgtttcttcatcaggactccacattccgcgatccaccgcttcaagcaatctgccagacatatgtatgagtgcataaggattatcttccgataaccattcccggcaggactcatcaaagagaaatgtttcagcaagtgactggtactgccattcttcaagaacgtcagcagtagcatcccatccaaaagcaaaatcaaaaaggtaagttaattcctgtgcccccctataccggtgaggtttcagaccttccagccattttggattctgaattcgacttctaaacagaaatttactttcttcttcaatcgtccggatgaccggtttatcaggatcagaactatcccccacaaacgaaaccggatctttttctccatacgctttggtaaccgcaatcatacctccatgatacatgaaatcatcatcattatctaatatatcaagttctcgcgaattgtggttttttactgttacatcaagtttggagagaagagttttgaaaagatccttcataacctcccctttatatttacgcccatatgcatgaccgccccagtcaagataagtatctgcaagatcctgctttttttcccatccggatgtaataattttatctgcaactcctgctccatatgttcccggagggcagccaaaaatcctgataagtgcccgcgatctggcctcttctggatccattccatttttcagtgattcaagcagggatttacgaagatgagatgcaagataattttcttcatccttttcatcaagggttgcaatcatctcaactccttcatcaatcaaatcgacaagaccgggaaaaacatcacgaaagaggccggttatccgaagagtaacatctatccgtggccttttcagatccgataatggaataatttcaagacctgtaactcgtcctccatatgctgaccagagaggacgaagacccataagccagagaaggtatgcaatatcatcccctccggttttcatactgtcggtcgcaaaaatgacaattccaacattttcaggataaacaccttcatctttgacgtaccgctcaatcatctgattagccatcttttttcctatggcaaaagcagcaggtgttgggattatcgctgggtcaatagagtaaaaattcctacccgtggggaggatgtgggcatttcccctggttggagggcctgatggaccaggaggaacatacctgccattgagtccggatagcaggttattcatctcatcggtggtctgttcaaggttagggacaatatttttacaaatcttgtaaagtgtttcgttcagatctggatcattgcataaatcccgtgtaatatctggtattttttcaggattacatcctgtagcaacaatgcttcggattatatcaaatgaaagtgtatcgatatcatcgagtaatgcaccattcggtttttgaaataaatcgttccaaccggaagggttttcctgtagttcggaaagaacaaggcccatagattttccaatggattcacgaagtgagggtattgatccatttttaattcttgtcagagcgtagagcatttcagaaaatctctctccctgaggacaaaaaccataaatgtgaaggccatccttgattaaagaatccctggccgtacatagataatcatacattgatcccagcgatactgccagattctctggggctgacagagagatctgaagatcagaagcaaggtttgtctcttcaaccaatatttgaatttcttttaggatttcagatgcttttacgtcatcgcggttcttttctgcacggaaatactcctggatatatactgtgagttcctcaagattaccatatcctcctgcacgagtcatggcagggatgaggtgatccaggataactgctgaagatcgtctctttgcctgtatcccctcccctgggttatcaataatatatggatacaggtgtggaagatcctcaatcatcatatccggataacatgttgatgacagccccacacttttacctggaagccattccaaggtcccatgggttcccatgtggatgattgcttgtgctttgtatccttctttgagccaccggtaaaaagcaaagtactggtggggcataacaatgtcagtactatgataaaccgcatcagcgtcctctaaaaatccgcgtggtggctgcagtccgatgaagatgttcccaaacatttttcctggaataagaacctttttttcggcagtcagaattgttcccggtggttctccccagtcatgtataattttctgactgcatatctccggtattttggagagccaggtcagatattcatccctggataccagatctgcagatttacttagtaactccccctcatccatacattcgggtgtgttcgtcagacctgataagagcaggtgaataagttcctgtcctgatgcaggaagtatttctccacaatcatatcccgcatttttcattgcgtggaggatttgaactacactttccggagtatcaagaccaaatgcgccaccgatgcaatcattggcaagaccatactggtagagaataattgcaacccgtctttcacaaaccggagtacgtcgaagtgaagcccatgattttgccatttttgcgactttccgagttctttcttcaattccattaatcttccttgaattttcatccggttcatggcatgcaattggaattgaaataatctgtccatcgtattctggccagactacatgagaagatatttccaaaatagaaagtcctgcgatattttcactccattcaccataactttggttggtagtaatgagctgcaggacgggaactccaagggaagaaaaaaagttatctggctgaattcctgtttcccctgaacacgataccgaaaagctgagctgggaaaaccccatcatgataagcagcacatcaattgtagttttgtcatcctccataaaataatggcgaataatttctgagattccaggtgatccactaattggatccggcgctgatgaacaaaataccggtacggtatccaaaccctcttcttcaagagaagagatgaccaagtcaactgctgcaagggatttcgaaaggtagtcgttttgccaaaagagaattcccgctttcaaggtactttttgggaggaacattcgatattctgatatctggatgtccgggtaccatcctggatgatatataccatgagttggaggttgtactggtttaggaatgctgtgatccccttttcctatctgcacatacacccaaagaagcaaagaacgcatgttctgtaaacccccaagatggaggtatgaataaacctgacgataatcgtcatttgagaatgggaaccaggatcgatattctgtcatttcctcttcgattgtactgataagaaacacagggcatttctctgaatttattgtttcccgaagccggggaaatttcttaaaatatgggactgaaccatggaggtttattatgataaaatctacagaagaaatttctttgagaacataagaaaaaacctcctcatttttatccaattcttcagagcaatattgaataacatttatattacaggattctttacgtaaattttttgcagcctcaaatagaagacgattttcgccactaccagaaccaagatagaaaagattaatcattttttctccttttatttgataacagatgatcctatgatgacttttgctggaatgattggaatttcctcccgaatgagtgcataataatattttactttaatgcaaaaaaacttgttctaataatatcataaattcttggatgcaatgatgaaattttctgtttattattgcatcggagtaaaagacttccatgaaggtatttaaaaaaaatgatggtgaccagattactgcatatatatgttttttagcagggggatggtaagatagaaaattgtctgatatatgcaataaagacgttgagagagtgaatagaagcaaataattttttgtaatttattttattttgtctgataaaaacaaaagatggtattaccgcaaagtatttctgtatgaacaataaattttgatctatgtcaaaattttttggttatgaaccgaagcccaagactgcaaagcttgccgatgagtttgaaaccaaggtcctaattcggagaaacaacaaatccctcgttgggagggtttttgttgacatcatggaagatgaatggaaatttgctgtgggttttaaccagatgggtattaccaaacttcatggcagagaaaatgaatttgaagttctgtacagataccagccatcggaagaatcaaaggtggttcgccttggaactgataccggtcttgagaatgactatcctgctgcgtcatttccatcacctgatgaattcatcatctgggcaatcggccaggaaaaacagattcagctttcacctgcctgaatgattcctcctttatttctttcaatttttcgattgtaattctgattattcattctgaagaaggcaatatttaaggtaaaaaaagcgcatggataaagatcggaaaggatacattcaggtatattgtggaaacggaaaggggaaaacaactgcagcactaggtctctcgctcaggacccttctctctggtggatcagtgtattttgcccagttttgtaaaggatcagagacggcagaattggggctgtgtacactctttgatacctttgtgatggaacagtatggaaccgggaagttcattatcagtgatcctactgaagaagacctaaagcaggcaagattgggacttgaacattgcaaaagtgtgctgtcatccggttattttgaccttgtcgtccttgatgagataatcatgagtgtctattaccggctaatcaccattgaagagattctctctatgctgaaatccagaaagtcatgggttgaagtggtactcaccgggagaaaggcgccacatgagttgattgaagcagcagatctggtcacagagatgaaaaaagtgaaacattattttgatattggggtgaaagcaaggaaagggatagaattctgatatctgaaattttctgggtaatctggtttctatccgaggttttgttatttccagccaataaacactccaaacatatcatactgtaagggtgaaagtatccgagcaaaacctgcagctttcaattttctatagaaaccatggtttgtgtcaagaaggggccatgccttctctcttccggatactgtctcgagaatctgatcttctggcatgccggtatctctcatgtgacgctcccatctgtttcggtatatcgattcaatccagtcctcttccggtctcataacatctccgcatataaaaagtccacctggatttagtttttgatatatctcatcaatgaggttttttctgaaattatcagagatgtgatgaagagtaagtgttgatataatacaatcatagttcccttcaggcaggccggtggtgatgtcaccttcgatgaatgtgcaccctgttaattcttcttttctttttgccagttccagcatctctggagatttatccatgcaggtgatctgatattcaggatattgactgagcataagtgcagtaaaatacccggtccctgaaccaagttccatgatagagatcttccggtgaggaatgaatgaaaggcatgtggaaaagaagagctccgcattcgggaggatgcgaaagaggttcgtgtcgtactgagtgatgcggttcaaataatgttcgtgatcagacatcattatatcaaagggtttcatgtatcttaattggtgagatattactcgtaaaataaacagcatgaaacttgtctttatttttgttacagagttatctgaataattcagataaggtctctcatcacgaggattacgattggtctatgttactttctttttgaagtttttatctccaacaatttctaccttcataatgacgttctggttatcctcggtatttgtaagagaggtttccatcaggtcagaatgataattcggttggtttggagaacggtccctccctattgccgtgtgctccagattctcgtaaaaattctcttttttcgagattaattgtcatttgaattactctcaatttgttccagacaaagggaaatgattgaataaatcatttttttatcttctgacttgaccaaaaatggaatattttattctttttctgaaaatgaaatgtaattatgggctatttatcctgtaacaattttacctcatcaataccttacaagactggtgcataatattcgcccatttctgttccggaaacaaaggtatcagcatactcttgtaagacatcttttggattaaggtctttacattcatccgggtgcaatgcctttgcaagatatacgagaccagccggactccggggaccataaacaaggtctccattcaggacaaacacttgtttttcttttactgcatcaagtgagtcaaacccggttcttgcaatcatctcttccctgacctgttccagcgttttatccggcttaagggagactgtttttataattaccgacggattctcactcataacccattcaggagtgacttttggccattgttcaccaagacttgcagcaaggttttttcccctggctattcccataagaatatctattccgctgtctttgccctgagcagaataatcagaatatccttcaatgtatgctgtcgggagatcttgttcaggaatatttttcaaccgtgacgtaacttcatcctcccatttcttcatgaaggtaagatattgttctgctttctcatcagcaccgatcaatgttcccagagatgtaatatcctgtttaagagtattgaatttataacagtcaagataaatcagattaattcctgcgtttttcaactgttcagcgttctttggtttggaactggaatacgaaatgacggcatctggttttaatgcaagaatccgctcaataccgggtgtctgccagtctccaacacttatcgcgtttggcatgtgtttcatgagtgcagtatctttcatggtactatcagtaagaccaattatgctgtttcctgccccaagaatcaccaatgcttctgctgcatcactgttcaggcagataatccttttcgcagcaaatggaagggtgatggtatctcctgacgtatcggtgaatgagacatcagcagagcaaaatggtagtattaatccacaaacaatgacgaatatcgcgaagtaggaaatgtacgagtttttcatcatggtaatcatcagttttttgttcgtctggcaatacaaaaagcgtaggaattctcatacctggacttttctgaatacatgaactgcaactccgattatggacacacacaagatggataaaaatccgatctgagtcagaggaatctctccggtctggaagatcctgatcccatctatcgcaaaactgagcggatttatttgggctacaggtattagccatgagggcatctgttcgtagggcatcattgccgatgaggagaaaaacaggggcatcgtaatcattgcgttggcagcagcatattgatcatgatcatccaggtagatcgcaatagacgccgctgctgaagcgagtaatgccccgaaaatgatcaggataaggtatgttcctgctaattgggatggagtatagagtttcgccccaacaagaaaagcgaagcagagaattatcgttgactgaataattcccctgattgaaattaccagaatctttccaaacagaatactttcccgtggtgggggaagagcaagaaatttattaaaaaatccaagcatgcggtcaagaatgagtagtcctccaccagcgagcgatgctgagagaatagtcatcacaagaattcccggggttacaaagtcgatgtaattatcggtaaaggatatcggaagggccaggcctacaaagaggagccacgctgcaggcatgaccatggcggaaataaacccccatttccctctgaaccaacggatcaaatcccgacggcagtataccagaatcggattcatcctctcctcccggtcatatttcgaaacgtgcttagattaaaaggacccttatcctcttcagttccgacaagatggagaaatacatcatccagagaaggttttcgaagtgacatggcggttacggtcacgccatttacactcagggcatctttgatttgagggagagcctcgtctcccgaatcagcatagaagattatgctttcatcttcgaaaaaggcgaacctgacaccgggaagatcaactcctgtgtatgtacctgaaacagataccgaaattacatcttttgagataatttttttaagattttccggagtgtctatcgccttgatagtgccatgatcaataattgcaaccctatcacagtacttatcagcttcatccatgtagtgtgtcgttacaaaaatcgtcatcccggcattgcggagtttcttaatatgctcccagatcttttttcgggctgctacatcaagcccaaccgtgggttcatcaaggaatagaaccttgggattgtggacaagagcctgggcaagttccagtcttcttctcattccaccggagtatactttggcatattcatcagcacggtcggatagttccaatatccggagtacttcttcggatcgttcagccgggttttggactccgtacagttctgcaaacatatgaatattctctctcccggtaagcctgacgtcaactgccatatcctgcgggacataactgatcgaatccctgactttccttggttcggtctggatattatatccacagatttctgcagttccttctgtcggttcgaggagagttgtcagcatcagaaccgtggttgtttttcctgaaccatttggaccgagaatgccaaatatctcgtttccaacggagagattgatttgatttacagcacagaggttaccgaagttttttgtaagctttttcgtgattattttactatatggacagttttgaatttcttttttcattcagatcacatttatcggtttgggagatgtccggtcttctgcctttttccaatcaggtaaaacgtacctgcctgcatctgttgtgacaaactgcatggggattccatatactgaaatgatattttcctcagtcattacctcttcaacagttcccatactcacaatctctcctttatccagcaggattacccgatctgcgtaatgataagcaaaattaagatcatgcactgctaccaaaacagatcgactttgagaatctgcgattcttttaatcatctggaatacatcaatctggtgcttgatatcaagggcactggttggttcatcaaacaggaaataatccggttcctgggcaattgcacgggcaatgaaaacccgttgtcgttctcctccagataattcggtgagcattttttcagccatggatgtgatatggagcatttccattgcagtatcgacttttgccaggtcatgctgggtcagtgaccattgtacatgggggcggcgaccaagaatgacagcttcaaggactgttgaagaggtgagatactgaaaatcctgggggacatacccaatctttttcgctatctcattccgggaaatagaatccaggttctgaccttccaatgaaaggttcccatatttaggctccataattcctgcaattgtcttgattaacgtgcttttacctgatccgttcggtccgatgatacacagaacttctccaagaggaagagagaaactgatatcagagaggacacgaatggatccataatgcacagataatttttcaacgacaagtgtcataatccgcctctcatgtgatcatccggtgttttccccgtaatatgaggaacatgaaaaagatacccccgattacatacatgataaccccgaccgggatctcaaccgggtccataatcgttcgtgcagcggtatccgagatcaacagaatgagtgctcccaggagggcggaacaggggatcaggaaccggttatcatttccaatcagcattctgccgatatgggggcccatcagaccaataaatccgataatcccggtaaatgcaaggcaagctgatgctgccagggttgagacgaacagtccggtcagacgaagtctgttcacattgacccccaggttttttgcaacatcatctccggctgagagggtattgagatcccaggctttggattccagataaaggaaacagaggagtgaaattggagcgacgataataattgctccccagttcgcaccccacatccctcccatcaaccagagggtaatctccctgagtttttcatcatttgtcaaatacttcagaatcatgacaccggcagtgaagatatacccgataacaaccccggcaaggataagggtagcacttgatgaacctttcatctgtgagattgcataaataaaaagaattgaaaaccatcccagaaggaatgctgaaaagatgatgacgccgttttgaaattctttcgggatgaaaggcataagggaggctccaaagacgatagccagggcagcaccgaatgatgctgcggatgagagtccaagggtaaaaggacttacaagcggatttcgaaggagtgcctgcatgacacatccggctatcgcaagacttataccggtaaatattgcaagaagtacccgtggcattctgaaatcaatcaccaccgtcttttcagaagggaaatctttcagaagatccgggttcattactgcctgatgaactatggtaaggatccgatcaaaggagagatggtaggatcctgcattcagggcataaatacttgcacaaaagaggagaatggtaagccctgtgataactatgaatttctgttttctcccggataggtatagggagatggatgcattttctggtgatttcatcaaaaatttctctgatggtacatgaagtaattcatattcaagccaaggatgttttcattcctgatactactgcactggatagatctgaagcagtcagatctgagatctggaagtatcgtccctgtgtccgctgtgcaatgaaaggacagaatccaagttgaatacttaaccgtcctttctgttttgattcggtatcgataatgacggtttcaattccggcttttaccaggtcatcggtaattaatccaatctcatctttcagttttcctccatttccgacattcgcccgtccatcggtaataagaacgagtaggggaagtaatgatggatacttttgtttctcccgcatgagtattgtaagggatttttgcaatccggctgcaagcggggtttttccaccggttggcagttcagataagcgctggtatgcaagatctatgctggatgtaaggggcagaaccacatctgctccttcaccccggaatgcaacaaggccgacacgatcccggttctggtaggaatcttcaagcagggagaaaatagccccttttgctgcctccatccgctgttcaacccccatcgaaccacttgcatccacgacaaagagggtggcagtggccgtttttcctatccgtttcttctgaaggacttcatctgaacggataactatggccaatgagtctgacagacgcatcttctgatacggggaaacggcccggattgtggcatcaagggcgatgtcacgtccggttggtcttttttccgcaccgatatactgaccacgccggtctcctccgttcgtatcaaaccgtcgccccggggcgtatcgtttttcaaccgttcttcggtccggtgattttatcttatccggatctatgggcgatccaatccggaacacctgctgttcctttggagcgttcccttgtgaagctgatggatctgttctgttttctggttcagattgctggttttgtcccttggattcctgttgatcagatgggggttgatccggagggttgtcctgctgattctcctgattttgggaaggttcgttcatcaggtcatcaagcttttccggatcaacttttggctcctcaaacggtcttcttctcatccggtggggaagggcaagttcaatagcctcccgaaggtcgtcctggtttacggtcttccgaccatcaaatgctgctatggtcttcgctgtcctgacaatggtgatctcggcccggtgtgttcgtaccccaaggccaatgcacacatccactgcttttcgcaccagatcatctgaaatcgttacactggggaggatttttatcgctttccgaatcttttttgcgatatctttctgctttcttttgaatttctgacggaaggtatccggatcttttaaaaactcttcagatgtcttgacgatcgccattcgttcatccggattatcaagtgcctcaaccgatacctggagtccgaaccggtctagtaactggggtctcagttctccctcctcagggttcattgtgccgatgagaataaaccgtgaggggtgtgaaaatgatattccttcacgttcaaccgtgttcacccccatggcggctgcatcaagaagcacatcaacgacatgatcatcaagaaggtttacttcatcaatatacagaattccgcgatttgcatcagcgagtattccaggttcaagtgctttaattccttcctttaatgcccgctcaatgtctatcgtgccgacaacccgatcctcggttgccccgaccggtaaattcaccacccgtatctgctggtcttttggatttggcagagatttttgtttctttttttctgcacagagttcacaaaattcagattcttttttcggatcacaggagaacgggcacccgggaactaccgttatcatgggaagtatttcggcaagagaccggaccgcggttgattttgcagtccccttctcaccccggataaggacacctccgatggtcgggttgatagcattcaggaccagggcttttttcatctggtcctggccgataatagcagtaaatggaataagcggttttttatgatgatgagacattatttcccccctttcatatgaccaatcttttctttccaggccgaaatatcattcatcgtgtagatatcgatagatccaccctgtacctgaccgtaacttccatccatccggtcttccatccatccttcaatcatcagatatgcctcttttactccctcaattacatccggatctgcttcccagactccccgttcatgagcttcaaggagtctgcgtccaatctcttcgagagcatagggattgttctcttcaaaaaagtcccggttctcctgatttaagatgaaggcccgggcaatgtcatcaaagatccagtcatccacctgtccggttgtggcatcccagccataaaccctgccaattcttcgggagagttcacttgcgccggagtacccgtgttctttcagaccgtcgatatattttggattgagaagttttgtcctcacaaccctggttaattcttctgcaagagtccggacttctacctggctggggtcgcgggtatccccataataggtggctattttttgacctttcacagtctctgcagcgatggtcatgcccccgtgcgtcccgaaatagcagcagcagccaaggagatcatactcatcggttgctgttttattgaacgtgacatcaacggttttcagctgggcgatgagatcatcatgtgcgggtcttccatagacgccctttccatacccgtacccgttccaggcgatgtaaatatctgcaagttctgtctcttctttccatgcagaggcatagagagccaggtttactcccattccatacgtcccggcccggctgccaaagatccggggcattagtccggatttatctgcctgatgtttcctgacataattcatctcgtccggttcatgaagtgccgcgacctgagcaactgcatcatccagcagatcaatacagttgtagaaacagtcacggagaatgcctgatgcccggacattgatatcgattctcggccttcccagtgttgacagggggagtattttcagactggtcacccgtccctgccggtataccggttcaacaccgagcagatggagaagttttccgaatgtttccccatctgaccacatgatgtctgatgccatccagtagacggccacggtctccgggtacctgccttcttcagtccggtacttttccagcagaacctctgccagttttctcccaaccctgaatgctgcctcagttggaaccgagtatgggtcaagactgtaaaaattcctcccggttggaagaatatcggttctgcccctgctgacaagacctgacggacctggctctatatatgctgcggagagtgccctgagtaatgcctcatgctcatcagaagaaccgatgagatctgagagctcgataactttttccgaaacctggctcagtaatggagaatcaggtcggatcagtcgttctcctaaggctatttcagcagcattccgaggattctccccctccagaagagcagagacaaatttttttgcctggtcatccagcatccggtgaagtgcaaattcaccggcttttggtatcatatcaaggcctgcaagatccagcataagtgtacgcagttcctggttgaacctgagcaggccggtgatgtatgctgcccgtttctctccgatgggaattgaaccaaagatgtgcatcccatctggaatctggctgttatatatctgtgtcaatgatgtatgagcggcttttatgacctcatccattcctcctcctgattctttgatctgttccagtttgatctcctgcccgagattggatctcctgataaggtctaggataacatgttccagagcatgggctcgtgcaggatctgcatccctggcacgggtatattcatctattcggtctgctaattctgataattctccataaaggccgctttcagtcataatggactgcatatgaccaatgagggttgctgcagttctccgcttggcaatcgttccttccggggggttgtcagtgttgtagatatagaggaacggaaccgggccaaggacggcatcaggaagacatgaatctgataggacgactgattttcccggcagaaactcaagagtgccatgagtccctacatgaacgattgcatcggcctggaattcttttaccaggtactggtacgtggcaaagtaatgatagggcggcgggatatcgggatcatgcaggattttacagacctggccatcacacctgcttcccgcacaaccccgtttcggctgggtcatgacgagaatatttccatatgatatgccagtgatgaccagttttccctcatatatcatccctgccggcactccgtctttctcttcgccaggaggatcgccccaggtttcccgaagctggtcttgtaatttccggggaaggctggttatccatggctcccaggtctccctgcccaggagagctagggcacctccttttgtcaccgtttcagtgaccgatgtccacctgaattcggagagggcttttctctcaagaatggtcgtgataagttcttttccatccgcaggtgggtctaccgtgtacccggcattgttcatcatctgcagtatctgtgcaaccgattccaatgcatcaagatgggcagcggtccccacggttgcttcaatagatgcacatggcgcattgtttaggataaaggcaactctccgttctgcaggattcttctgtttgagtcgaatccacccagataccagctggccgatccggtcaatccgttcaggcagcggatcatgccactcggtctctcccataagcggatcatcaggagatttgacaccagccgggatcatgctggtcattccaagaaattcaggaacaacgatggcccagcctatctccgatgccgtaagtccggcactatcctgttcccagtctgcctggctccggttatagatgatcaccggatggataatcgggacattcaggctctttaatccctcaacggtctctttcgtattccgggataacgtgactgactggagattgatgagaaggtctatcttcccggtgaagtaatggtcgatgacctcctgtccgggccgtgccccgagatctgcatccccggtcccaatacagaataccgggatgacattatgctcctgttcaagtcttcggatcagggcattgataaccttcaggtcgcggttagcccagtataaccggtaaaagaggatgccgatggttgatgtgtgtgtttttccccgccaggtgaagtaatcatcagtacttgtatagattctgtctgcatcaggatgatatatgccgtcccagactgccggttcgggggggtcatatgacatatcttcatgaaggacttcagcccggagatacctgatgaggtgatcgaggttcttttctccgccatagatatagtatgcagatgcggttgcggcaacttttaccgggaccgttgaagccgatagtccttcctgatcatacccgatggggattaccggtataccttcaggaatttttgggatgacatcatcccagaagggatcggttgaggggtgaataatgataagatcagcggtattgagatgagcgatatatgtattgagggtatccaggtttcgtgctgctgtactggtaataaaggcatgttctattccttgtgagttacatgctctggtcaggagcgggagttctccgccccagatgattcctgatattttcataatatgagtccttttttaaaatgattttaagtcatgtctatttgttcctgtgaggtattttaaaatcagggaatgttttttagtatgtgtgctggtttttctgaaatggaatttatgtactgaatatgaatggtttggatgaagagccattttggaattcactctactctataggggcgataaaataataattttttttattatgtaaaataagttcatacgaaatattatttattcagaaacaaaagtttagatattcttcttttaataaatttaatcttatatgtctcatttgtttattgagagaaaggaattgaacccggaatagatatgaaatggtcctgtatcgctctcactttctcttagttggtggaaatatattatcagattaaactgaaaaaagataatccgggatttatttcttttatccttccatttttcgggatttgtattcataatcagatataattattacaagactaattattggtccaattaatgataatggtgttgtcgggttagatttattgtctgattcatcgggcatcacaagtgctttattgtatgccagaacatccggaagtgattcaacattgggtaatgattttgggaagttagtaaaaattactcgctttgcattgatgccatgatacttcaatgcttcttccacaccttttgccatctcttcggattgcatattttcaataatataccggacattccggtatttttcagggctattgtaaatatctgatactaacgcccgtggcgtgttctgaccctggttataaaaatcaggaccgaatacattgacaatattcaaaccaagccatttatcagcagcatcagattgccagatcatgacaatgacatcctgattcctgataacatctttctctgcttctgttaaatctgcggaatcaattttatccaggtattcagttagtcttgattcataataagaggcattagaaggatctgcctgccttaaccatcctgcaacctgctctgataaattttttgcagtatcgggcgtattccatgaggtcccgggaataacagttttccaggtaatgggtttgaatccattagcgtccataaacctgtcaatatatggtattaccatttcagcatcaagactgtcattatgggcaacatacagatcggcatcccggatgaattcaatctgcatctgcatcctgtttggaacaatatctgtctgcatatgagggcagatggaagggtcggtgatataaattgcatgcaccttttctcccccgataaactggattggttcccagaggactgaggtggttgacacaacattaagtccggatacacttaatggaaatataagggttaatagtgtgaaaaaaaataataataatttaatcattcatacaatattgcgtacaataacattataatttttcttttgtaattctcctttttggtgagaggattactgaaaatacaagaataaatgagaagaaaactgcaattagaggtcccaccggaagggagcattcaaggccgattaccgctcctgaaatgctgataattgcacccacgataggagcaacgataaacatactgctcagttttgtacaaaactgaagagcgattgcagccggggtgataagccatatatagagtaatagcccaccaacaatcgggagacacaatgccacggtcagggcaatgacaaaaagcaagacataatagatgggtctaacacggataccaaccgattcagcaatttttttgttgaaaatgatgcaggttatctccttgtagagaattgccacaaatgcgaccgatacgaggcagacgagggcgagaagataaacatcttcacggtataatgaaattacatttccaaacatcagtcccatcgcagaaaaacccctccccagcatcgtcatatacgcaatgaagaaaattgcaagtgccatgcagatgccaaaaaggagtcccagggctgtatcagcagatactttcgccttgtcgctcaatgggcctataagaaatgctacacaaatgctggcaataattgcagaaagggtggcgttaatagaaaagaagataccaattgccgctccggcaaaagcggcatgggacatcgtaaaccctattgaagagatctggacctgggtgatgattacaccaagaacagcacatgcgattgatgcaaaaagcattgcttccacggtccggcagaccacgatgtttgtaatgatgaattcaagcatggatattccccggtccacagtttctgatcatttgttcaacacttcctggtgctgatacccggttcatcattatcttccctttattcatgacaacaaccctgacgtcccggtcaggaagatcatcaaatgcatgagagacaatgagaatagtcattccctcatttacaagccttattaaaagtgaatttatcatgtccctggcaaacatatccaggtttgaaaacggttcatcgagaaggagaacttccgggtttctggctagatttaatgcaaggaggactttttgttgttgtccgcctgatagctggccgataggagtatccttcaggtcttcaatgccaaggagcgacatagctgatctggcagcgatgtgatcttcctccttcggttttcgaaacgttccaatcattccatatctccccatgatcactacttcttctacggaaaagggagtgagcgggtcgaatacaaagttctggatgaggtaccctacattgcatctgacccggtttccatcctttcggacatcatatccgcacaccgttgcagttccatgggttatggttagcatcccgtttatcgtttcaaggagggtggtttttccggcaccgttcggaccgccaatgatgacatactctcctttctccacagagagagagatgtcggttaacgtagggcggttcgctccttcataggcagtatagatgttatgcaactgaatgattggatcagattttatcatgaattctcctttttttgacaaataattaattctgaataaaaaattactattttttcaataaagaaagaaaaatagaaaaaagatctatgttaatgaaactgtaaagtcttttactggtatctgtccagatgcaattgactttttcgttgctttgtcgatgatgtcataagtcagataatcaccgacatccacactgaatgctcctgcggctccactcggcttccaggaaattttcttccatggagctgaactatctcccgatattctccacctggcataatcagcatgaagaacaaatttcgaccctggagaacttattgaacctttttctggaaatgtttcaaggtattttgtccatccctttgagaatgtggactggatatttgtatgatcgccgaagaaagaatcactactttcaggagtttttccatttgagattactgattttgcactggggtatttggtacaacctaaatatatctcaacgttgtttagattaatcccgtctccaccctgatgttcaaagacaacgtatatgtcagcagcctttcccgctactacattaaaatcataatcagtatttgagccatcatatgcttcgttcacaactatatctttagcaacaatacttgcctggggtgccttactggtatctcctgcaaaccctccagcaaaccctgaaacaacagcggcgatgataattgtcaccacaagcatcagcagaattcctatgaccggcgaaaccgcactatccttatgttcaataaatttcatctttttcacccctgcaagtttatcttcgtatcaaggatgtacttaccactcggtttatggagccatttgatatctacctgtgatccctgctgaatgcattgctcaagaagatctgctcctgctgcaaagtcagctgcgttaaccgggtagagtgacgattctggcaccaaaccaaggaatcctgcagtaacaccttttttatatgttcttactacctgacccggcatcagggtataaactccaaaccaacatgggttacttccacctgcatcaatctgggcagtggtattataataattcccaagcatctggtcgcgtataaatggtacacgagtatatccggtggttgtttcattctggaatggagagttcgcgttctgcttgtgagttaccaccgttccatttggcaatgtcaggtaagtaataatttcaatatctttggttggaagtggatccccacttaaatgctcaaagtaaatgccaaagttgtttttatcaatagcatcaccatagtaattcgttccgtacccggtctttacctgaatacttgcctggggaaccttttgtgtatctcctgcgaggcccccggcaaacccggatacaacggctgcaataataattgtcacaaccagcatcaataggacaccgataactggtgagactgcgtcttcaaataaacgataatttttcttcattcttttctcctccggtcagctggtccttacagaaaattccggcacgacgactttgccgctggagatagtcttctgggtgtttttatccatcaggtcgtagaccagtacctgcccctgctttataaagaacggatatgctccggcctgctgatgccaggctacctgacctgcgttgtttgcataatctgcgtgaaggacaaaacgctccccgggtttaacggtagtactggttttatccgggaatttttcgatatatttactccaaccctgactccatcccggaatggtagatttcactccaatttgtccggcagttccctgtgaatgagtcatatcaggtccggtttgaggagttaatgctctgcttaccactgttccggaatggggttgatctaaagcacttaaatgcatttcaaccccatcaaggttgataggttcaccgcctttgtgttcaaaagtgataaatatgtccgctgcaggattggttgctccctgtgccggagcccgtagtccctgtccaaaattgacatttgaaccaatatacctgacatcttttatctggaaatctgtaggattgatcgacgcctggggtgctttttcctgaccgcctgataaccctccggcaaatccggatacaaccgctgcgataatgattgtcactaccagcataagcagaataccaataaccggagagacagctgaatctttatatgtaatttgtttcatggtctctcacttcctcaaaacaatcttcttatccagtatgtatttttcactcggtttatggagcagtttgatctctacattcgaatttttcgtgtatgcatcatttaatatcgcggttgcggcggaatattcagcatcagttcccggctgtggattacttaccagaccaaggatgtttgcagtcatgttggtatggtaagttctggccacatcgcctggaagccatactgcctttccgaaccatgcagggttttctgctgttcctaatgtgtcagttccactcaatacccatccggttcctaaagtaacatcagctccaattggattacatgggtaagcgtatttctgagggtctgtcagatgaggtcctctggaatacatagcaactggatttgtatttccccttcctagcggtgaggaaggagtctggacatgttttaccaccgtaccattcgggagggtaagaaaggtaattaactcacaatccttggtcagaataggatctccccccagatgctcaaatgatatttctagttgtccatcctgacttcctgctttcacctcaaaacttgcttggggagccttttcctgtgatccggctagtccgccggcaaatccgctgacaactgcggcgatgataatagtcaccaccaacatcagcagaacaccaactaccggcgatactgcacaatctttccttatcataaataattctccgtagctctcagttcatttctttgagctaatttagtattaattttttaatacattaatgatttgataatactaattttaattttgtattatatttattgcctaaataataaaattattaaccttcatataaactattttcaactctaaattaaaataatgtaagaatgaaaaactcacatttcctcaatatcctgttctctcctctcattttttttatatctctctctttcatactcacctccggttgtctgggtattcctggattacctgattatgaaccgacgatggatactcaggaacaaacgcagggggaggacctgtcggagttgaacgaactcaattcttatgaacctgaatttattcccacgacaccggaacctacccccactccactcatctcaaccgtttctgactggaacccctatgagatcctccccctgccccctgcctccaaaaaccggacatcaatcctgaaaaatcccatctctctcaatcgccagcacctgaatatcacgtatactagctcagtcggactgggaggatatgcggttgggaaagttttgagcataacaaaaggcccgtttgcgatctcatacactattcaccctaatgttacaaacccccttctcgtatgggcaaagcttaccgtcagtgatccctggcaacggataatcgccgaggatggatataaccggggatactcaagcgaagaaacaaagacgataacgatataccgggaaggaatccactacctgactatcgaaggagaatttgcgacagtggattattccgtaaagaccggagatccggcactcgagatcacaccgacaccggttccggaatattatgaagggacatggccggaaggggaggggccgtactgatgggatgattgtgggagaggtaggtggagatcaaaacaagcctggataccaaggagaattggttcatgtggataattcaatacaataacttcttcgctatcaatttttgcttatctggttacgtagaatattgttatgaaagtcatttcatcaggatttagaatggcgaaccaatattaaagtaataagatctgagtggtatttatattttatataaaaattgatcgaaatttattaataatttaaaaaacttatttgctttatggtaccaaagatccctggtattacgaaaggccctcggaccttgagaggtataatgaataaggcaagtactggtgacggtaggataaaacctgaatataagaaattactagaagagggtattttttatggaattcctaagaaaaagagaaaaaaataattttcatgtcctttttcgccagtcttttattttactttaaccattattcagtttaactgcctaaataatcatttacacatttctcaattatgatatgcacaaattggcacatatgcacaatttatctatcctggttgcaaatctattcctatggaatcgagtgtgtataatataaaccaaaatgagattaaacggattccgattaaggttcaaacatggcaaagtctccatgaactcaaaaaggctgggcagagctatgataacctcatcgctggaatgataaaacgtgaaaaagattttagagattggcagatggtaatggagattgatcaatcgggagaatttgagccttttgaggcagaacaaattatgaacggggatttaacggaagaggagtaaaacccgtgtatactatccttatagaaaaaaaggcgcgtgaatatctccagaaattaccattaaacacgtcggattattgtagaaaaaattcaggaactacaattaaatcctttttccgggggcaatagagaaaaactggaatttcaaaatcctccggtagtatatcgtctccatatctctcgttcttatacagttttttacctcattgaagaagaaaaaaaggttgttaaaattgcaaagatagaaacgattgaaaaagctcacaaaacatactcccggaaatagtattattgccatatcaataatcatccgttccctgctctccatactctcgtctccatcaaacacgaagaggtcaggtcatttatccttcccgatctgagcttcttttcattcctggtttttatcattttaggaaacggaatttgacatgaagaaaacaataaccatttccctggatataggacttttataaattcctctcttgaaggatatcaacacccgatccctacccccattatttccaaagtcactgactggaatccatacgaagttcttcctctcccgaaataaatcggaaatcgcacatcgatattgagaaatgatgatacaaatgccagaaaaccacttaacaccacattttcaggttctgttggtcttggtggatatgcaaacggaaaattattgaatatcacaaaaggcccgtttgccatcacctattccgttcacccgcacgttacaaacccccttctcgtatgggcaaagcttaccgtcagtgatccctggcaacgaataatcgccgaggatggatataaccggggatactcaagcgaagaaacaaagacgataacgatataccgggaaggaatccattacctgaccatcgaaggagaatttgcgacagtgaattattccataaagaccggagatcctgcacccgagatgacaccgacaccggttccggagtattaagaggatgaatggccggaaggggaggggccgtactgatgggaaggaggtgaacaatcgagtagaacagatatatttcccgaatccctcccatcctcccaactctggttctcgatcctgaactctttctccctttttttcgttatctcatcacttaagtttcaaaccatgcagggtatatcgaatttctcaatctctacaacaactttcttcccctgaaggatgattgccagttttattattttatccggctttatgccggcattgaggatagcagatatatactccttctcttggatctgttcgattgcatcttgggcagttttctctgtatcggttttggtatctgtagttttaaattctataatataggcaaaataattatgactttttcttggaatcatgagtatatctgcccggccataccctgcctccgggtttgatctgatctcatagatatttctcaggttcgccaaaagtccgagtatgaatgcatgaaagactgcttcaggaagttttgccagatcatacatgcttaccagacgtaacgtaagatcttgtaaaatactttcaagatgctggagcgatctttcacccagaaaacatttcataagtgcatcaagcccaccatctgtctaatcataaagtgactcaatgaaatgttcatacatgtaactaatttcccgatttgggattgaaagttgataggtaatcctcccccgaagatcaggttgcggattttcagccttcagatatccggaataatataaaaaactccagatgttcatcggattttttccgatatcaggaaaggtaatggtttcagatatcggatagcgaatctctcccccggataaaagaatttcaaggtcacgtttaatttccagacccccggttgcaagttcctcgtagacaagagcatttgaagacgtattgagccatttcggtccgggaggatttggaattgcctgaatgtaacttatgacagaccaaggattgtatattgtctgctcaccgtatgaatacccgttataccagtcgcgtatgatcccggcatgactttgagcatgaaaggcatcaaggatacatttcatttcaggttcagtaaaaccgaatttatctgagaaaggacctatcataagtggacttgcaacgtccaggttattcagctctgagaagatcgattcttttgcaatgcgaagaattcctgttataactgcccgaaagagtgcatgtccatgttcctgttttaatcctgcacctagccattcccgcatgaaggaagccatttcatcataatatccccgtatccacgcttctatcatgggagtatcatattcatcgataaggattattaccggctttttgtgatattcatacagccataacgtcagtaattcaaggctgagtgaaaggattgtgtcagatgggcgaaaggataccagtgatgtgtagatctcctgatcctccaaacgcagagatgagaccgaaagatctgctgaagaacagcatctgccaatcatctgaatgatctgctctttggcatcagcccaggtattcccttttatcttttttaatgtcagataaatgaccgggtactgcccttgatggcacatatattggggatgggttgcgatagcatacttttcaaataagtatgaccggttctcgccagatttttcaaagaaatatttaagcatcgtcatattcagggtcttaccaaacctccgtggccggggtatcagagtaacgtcgctgccatcgataatctcctttatgagtaaagttttatcgacaaagtacccatcctgatcgtgaagttttttgaaatcatcagttccgatacgaaattttggcatctttcatctcttcccggtaattctctgatatctattgccctgaaattggatatcttttactgcactcatccgctcttgaatgccatactccagttccatcaaatacaaaaatgtatcattcattcacggcttatgatctacataataattgtcacctttcgttaaatgacagaaaaatgattaaaacagggccctgtctgaaaatccggtgatagcactcgcgaaattcgatcctgataatttatggttttcattctgtcttttgtaattacataatccaatgagatagatcagaacaaccaatgggtatacaatacaatggaccacctgaaaaaacgaaaagggatggacttttcaaatgggcataggtcagcccctctggagcagagtggtacgtacttcagaaatgaacagatataaatttataatttataaaataattttatgattattataataatatttttatggctggcttctattgccggatatctggttggccttataaattcaccttgaaaattttaaacaatagcgaccctctattaaaccgataatttctgattattttataaacagggttcaaattactgttatttatcagccaaaatcggatgtaataacaaatcctttaatctgactttattttggcgaaataccctgagtttacactcatgaaatcacatcacaggtctccagatcctcaatctctatgtatgtttccaaggattgaaaaaaaaacaccacgcaggattcctcctaaaaaaggtatacatgggatgatagatggaaatccgggtttatttggataataatcaataaaatggattcatataattgataggtaaaacgatacaatcatgcttgaggagaaggaaatgccctgtaaagcccggctaatagaaaaaccacaggcttttcgatcattttcttccaaacatctcaaaataatacgcattccatgcttctatttctgtatcatatgaatcaaaattcggattcatggcctctactatcgcaacggcaatcatatgtgcacacggtcctcctgtctgcatataatcctgacacgtgcaggtatcttcaatgactctatgatcgaatgaatcatcatgaattatataatgatcttgcgtttcccgtacgactactcctttgctcaccatcgatatcgcccgtctcccccttcctttgtacttttgtatgatccgttttttcatccgatcatcataaggagctccgagatcaagatcttcaagtggatccctcattctatacatcacatcccaaataccgttacctgtctgccttcatgttcaatcgtatcagtaaagatcctcttctcccagctctttcctttcttccggtcatatatgagcaggtatacctcttctgctccaaatcggtcagcatacctggtcacctggtcaaggcctttctgaatcgttgcttcccgtgaaccatacacaatcttgcattcgatgacaaaccgctgaaatgtatcgtcaggcagatgccaaaggataaaaagatcggtcctacctctgccaagtccatattcccgcgtaatctgtccgcctccgtttattatccgctgtaaaaatgcctgaaggagtaactgagggccggcttttcgataggagaacctttcgagccaggattcactgtgctcccggaaaaactgctgaaactcctgaagaagttttttcatctccagtctgcccctggaatcaatataccatgcaggtttttttgtaatagtaagctgggttgagtatgtgagaattctgggtattatctcctgatatataggatttgagattcgaagctggcctttggttgtaataattcccagatcctctgtgtaccagatgtcatcttccggaatcgtttcaggtccggattcaccacataatataggttcaataactctccggacacgctcttcctgtaatttatccaccagttggtctaggtgagtctccctcctctggatgagatgttcttttgcctccataaccatggacttacgtaccggattagatcggttcttcccctcttctattttgaaacagatctcatatgcaagagcattaaccagccagggctgaccctgtgtcaggttccagacagaggatagggcttcttcttcaaatatctgcccggtctctttggtatgttcaagaagcagagttctggtttcttcttcagtaaaatttccaagccgtaaggattcggctttgacattaaatgcacttccaccggtgattattgccttatctttatctgaatgaatccggtagtcacggacgtcacgaacaccacagaggatgattgatgatgggaacgacgcaggtctttcagtgtaaccagatcgaagttgccgaagaactgaaataagagtgtcaccaaccagggcatcaatctcatcaataagaacaacgaccggaagagagatctttttgcatatatctgataaaaccattttaaatgctgcatcaggaccatatacatcaatataatgatttatctgatcccttagtgatgcgtcctctatcgttaaatcagtctgaaatgcaagttcgctgattattgctttcattcctctcccaacatcacttcttgcagtctgtccggtttccacattcatatagaatgtagcaaatttcccatcacggttcaaatattcccgcaaagccagtagacatgaagtctttccactctgccttggtgcatgcagaacaaaatacttctcctgattgatgagattgagtatttctggtagatcaaaccgggaaagaggaggaagacagtaatgtttctcacactgtacaggcccggcagtattgaaaaatctcatcgtacgtagctattcatcctgtagtcaaataacttctcccgaagatacagatccatctgccggtttatgataattcctgagcccccggcatcatccctgccatcagcatccgggggttaatgttcaccgattactcactattgttcctgataaaaagagaaataaatattattccgtaaggtgtacgagtgcgatcacgattctgcaggatccgatgaaggttccccaatgccaaacaatcaatccctggatatgtgtgagatggtatcagagatagcacacccacacataattatttgatgtacgtatagaaaaatattacgattttatataaaattattattaaatgcctgcttctctaatttatatgaatgaatcataaaaaaccggggtcttcaccagatctcttctggaaagagggtattccgaatgagtgtatgttgccggttttgattgattacatgatttacttcagaaaacgggatattcattaaagaacaccattttcttcggacatgggtttggctcacgaaaattatgtacctatgccaggtcaggaatccatccggcaggatacgttctggcaggggggatctattcagacgctgaaactgttctttcacagaaatatctctcacaaatacaaaaaaatccgtgttttttcccggtttcgataaataaattatatccagaaacccgtcttgtcgtctctcatttcggtactattctgtatgctatgcggaagggaagaaataaacttgtgcttcgggaagggcctgaatctttagatatccatattcatccggatttgcatgaagagagttactcattactttcacaactcaattccccgacattcattcttcatggatcaggtgatctggatataccggtcagtaatgcattttacctggaacaaaaattgagacaaaatattgagcatgttaccagatcagtcctgcttgattgtgatcactggtttcggagtatgccttatgatacgatgaaccggcttactgaacgcctggatggttcctgtattcacaatagcatagacaaccggttgtatcaatgtctgtcaaggtttatctggggacatttgcaatcagaaaaggagaggttattattgactgagggttccgatgataaatttataagggcaccttctttttctttttctctatgagaacggttgttttaatatatggagtcctgtatggattgaaaaaaacggagtacattgcatgatctcgatatttaatctactatgttttttggttgttttatccggaacaccgatacatatcataatcacatctgattgtggaaatttgattcagacggagtacgatctgcctgcacccttattcatcaggtataattgggaattaatggcatataacatgagaatactgatgaatccaaagaatctttctgctggaattgaaaaagggaaagtcctttatcggctgggtcgatatgatgaagcaatacaggcatttgatgcagtaattcgtatagattggaaaaatgctgatgcatggtatgaaaaagcacttgtttattcgtatatgggttgcgatgaagaagtaatccaagcctgtgatagatctcttcaggttaatccggaaaagcctgaagcatggtttttgagagggctttacctttcagtccttgatagatgtgatgaggcgatactggcgtatgataaagttcttcagattaaaccgaattctacttaggcatggcacaataaaggttagagatatgagaggatgggtcattacgacaaagcaattactgcctatgattcagttcttcgaattcacccgtatgatgagctggtacagaaaaatcgtgagaaattaataaggggccttgaaaataaattcttcatttcatgaatggtaagtcttatccgagtaagtgtcaatggcggtttatttcccccaatctcgtcgggatcaaattccccagttagggcggaataaataacgcctgagttggggatttttacaccgccgttgacaacaatctgatataattgcttatatcgtttaatttttatgataaattttaataacttaatacatattttgaaatattcttaagtcgtttatttatgctatgtctgtatttacaactgaaaaggatcagaaaaatctggtaatagagaaactggcagaatttttttcaagtgtaggtgtgaaaaaggaatcggccgtatctccggttgtcgggatcatgcttatgattacaattaccctgatacttgctgcgataattagtggtatgaccgggggaattgcacagaaacaggagaaaccgcctcagttgttatttgaagcgtcagtattcattaattcaacgggaaaagatagttttttggatataagagtagtttctgtgagtcagggtatccctacgcgggatttgaaattagttactgagtggagaggtgatggtgaaccaaataggactgtgattaccccattatcaaaaaatgttgataatgaatttacctatccagtaggatatgagccgggtggtttaaatcctaaggatttcggcaactttactttactggggggaacccgtatgagtgcaaatagtaccgatattaaatatatggatgcaactctgaaaaattggaaaaatattcgggatggaacgacagtaagaatacagttcatacatgttcccagtggggcaataattgcagataaagaggtaacagcggaggtcataaatcatgaataatgaagcggtttctccggttatcggcgtcctcctcatgctgactcttactttgattattgctgcgatagttaacagttatgcaggcggtctcgtggataccgaaccgaaagctccttcagctaccttacaggtaaaatatagtcagagtggtgggatggagatccggcatgtgagtggtgatccaattccaacatcatcagttaaagtaattgttcgtccatctgaaacaatgggtagaaatgcaattcagaatgcttctgaagtacaaaaagaatacattaccgatttagatggattgaattcatgggcttcagggattacttcgtttaaagttggtgatgtttcatatattagtccaaccgatcttgatacaatacaggctaaaatcgcagaaaaagataggctaagtaatcccgacaatcctggaaatacctcttatttagaattctactataaaaattcaatgatatccagaaatgaagtattaattgaggaatgaccaaagattttttttatctaataaccacaaatcctattttcctcttcattaaaaatgaaaagaaagattccaaagatttatcgtcaaatccggaattttattttccattaacaatattggattatttggtattgtaagagtaaatgaattatgatcccagatagcatttgtccagggaatagagcgatagaatgtatcattgattgtggagtcaactccataattaactgcactatttgaagtatcaaaaattattttctcactaatgttgagtggagcactgtactgttttacttttttaagatctacaataaaacttccgtatccatttccgctgtaggagcgtttttgtaagggattttcaatgttaatgatatctattataatgttagtaagattattctgggattctgataattttattcgaggtaaagacatattatagtaattattccttgtttgttgtattttttcatctgtatctgaatatattagactcgtttttcgatttcccttagtaatgtaaataatcccatcttcccattcgtaaccctggttaatccaaaaattccctattggacggaaaataatttttgactggttaatttctgaatattgagaataaataatatgatcatccttatttttcacctgaatattaattgtatataatggattatcttgtacagatgtgtttacttctaaatatccagaagattttactggtgaaaaaaacacatcacctccgccaagttgaatcggttcattcatcgtcatattttgccgaaatgtcaggatttgaaggatatctgatgaaatttttaaaaaactttgttccacgttgtgaagatgctcaatctctgcctgttgtttcagtgatgggatataatatgcattgagaacagaaatgaaggatactacaatcatcaggagtaacataaaggcaacaaccggtgaaacagcgttatctttcatggctggggtacacctgaaaatattattgaatttttcgcaacaaaatcaattctagcattttgaataacaccactaacagtaatatggtctcccaaatcgaaaacaggtttatcatacataaaacttatttgccttccattttggagaattctaatatcagtaaattttatccagtcacctcccttatgataaaaagtcacattattattcgtaatcggactcatctttatattaactgtcggaacccgatcctcaggtaactggttcatcagacttatcgtcacaatcggcacgaggattaacacgagtgatatcattaaaacttcactcaggactgccgaaacagcaggttcttctctcattacacccctccgtttgctgctgcatctgccgcaaccctggccgcttcggctgcaatatccagctgatatggaataataaaaacaaataacacaaaacatccaaggacaagaagaatagcatgctttaaaccagccagaacactgttcgcagataactgtccggccataaggccggaaaaaaacccaagaaccaacccgatcctgaacatatcggtcaggtttccggatgtatcaaatgagatattgaaattcgtaaaagatgatacaaaggagacattcagggaataagcggtatacatataaatccctacggccaggtacacaatcatcacgtacgtgatcgcaatattaaaccggtccttctttaatttcagataatgctcgaaatcattgatggcaataatcaggacatccttgatataatcggtcacctcgcttgccttgaccaggagtgagatagcacgtttgactgataccagtccgattcgatcttccatcctgaccagggcgttaatggttgttgcccctctcctgatatcctctgatgtcatgaccagttcctgtgaaagcaccccgagttttgaattggagatcagactgatggccgtctgcaacgtaactcccacatctttcatatctacgagctgacggagaaattccggagtatgagattctacactgttcacaaaccagcttcttccttcatatgcaagagagggtggagccagtgaaaatattatgagcagacttatgaatgcttccagagacatccccggtatccattcattcagataacccaggtaatagagtgcagatacaattccgccacacacacatccaagtgctattccataattataatcggaaatatatgcacgtgccggatttttcagtaaattctccagtttgaatcgctttctctttgcttcaaccctctttaaaaaactcttgtcaacctttgaatattcctctttccctatcattacatcggaaaattcagattcctctctaggtttcctcgtaatatccattttaatggaggggagcatcaagtataggatgtaaatcatccctattgatccaagagcaagaccgatgataatcagcggcatatatccggcaagatcggattttcctcccaggttctgtgccacaatgataatgatcatcgtgataggtccggccacgaaagccgttacatagacctccgccatcacctcaatcgtttttaatattgattccagttcacgagctgcagactccctgaaatatgcagaccgggatgagagaaaatttgtcacgtctcctccactgtttgagagaagaaggagatcatttaaaaattcttcaagattcttcgatggggttactttttgcaggtttctgatagcggtatacagatcatcaccaaagacctctacgtctctgacaatgagcccgaattcctttcccacctctccaaaaagatcatcagcctcgtaaatcttccggatgacattatataatgtcatagtcgtggaaagggcctgcatatatgtgattgcatagggaagatcaagatcgatagaggattttctccctgtggcaactgtctgtggataggtgaaaatgccaatgataacaccaggtacgaggaggacaaatgcgataaggattgtatagatattggccattcctggaatgagctggacatcatcaggtagagatagtatataaatggtcagaattgcaaaaatactgactgatgctatgctgcatttgagtaacagtaaaaaataggaatattgtgaatatggaagatgagctgcccggatatattttcgaatattggttccttcaagccatgcatccacctgccggggagatatgaacatcatgccatcctccgcagatcagagatcatctgaatgaggatttcaggatcggtactatattgattgcggagtttggaaaggaacgatgcacgaagattcaactggaactgaatctcttcatcggtccagttatgcatgtactgaatcgtctgtaaagttttggattttttaaatacttttttaaatgaatcttttttcggatcatattcatacagggtattccagttaaccttgtcaccttctccaagaacaatctcgtgaatggcatcacatcgccggatcatcctgccggcacggtaatgaaatgtctgaataaccataaggtttagagcaccaaacatagccggagggacatttattggctcgtttgttagacggttcaatgcctcttcgatatttcccgcatgaagggtagatagagtggtatggcctgagttcatcgcctggaacagggtctgggcttcactccctctcacctctccaacaatgatgtattccggccgctgacgaagagatgccttcagcaggtcgaaaaggtccacgcttccccgatcattaaatgaattgctcactctggtctgaactgggagccagtttttctgggggatttgaatctccctggtatcttcaagagagacgatctttgaattatgaggaataaaaaatgagaatgcattcattgctgatgttttaccactggcagttcccccgacaacaataagactctgacgattttcaagagcaagccagataaatgccagaagttcgttactatacgtcccgaatgcaagcaaagtcgctggggtcatcgggtcggatctgaacttacgaattgtaaaagaactaccctttgttgaaacgacatcagaatacgtaatctgggcacgtgacccgttcgggagtgatgcatcaaggaggggtgatgtaagtgaaacctgtttatctgctttttgtgagagttttagaacgaaccgattgagttcttccgattcaaatctgatagatgttgggatacttccgtaatacctgtgatgaatatacacgggaagatcatggccgttacatgagatatcctcaagaagctcatcatacatcagaggatcaatcttcccatacccattcagattgcgtcggagataataatagataactgagagccgatcatcgtgaattttcggatcatacgtcctgacaatctttgcaacttcaccatattcgaggaaaagatctccccgggataccggtttgtcatataccagtacatcacggagtgtttcgtgtgtctcttcaagaatgattctctcacggggagtaagttcaggttcaataacccggtacaatcgctccttgtttttgtcctgtaagatgactgcatatgcatgcggctggtaaagccagtatgcttcctctgcaatatcatcatctctggcaggaatattcatgaccgatggaacctgaagaacatcaggaaccggggcttcgtcccggctgggcttttcttttctttgataaccggatagggaaaaccctttcaaacccttttttagaggattcaggagacggaaaaatccctgctcctcttcagagtattttaccggttcattaggtgaaggtaaagattcggatgattcttttttaaggtcacgttcgaaaatttttgaaatcagagcatcaatacgctcatctggttcggattctagtgtgtgagtgatcttcggaacagataccctttgattcttttcaggtaatggttttttattcccgtttttctctatttctatctggtagtaatgacctttatcatccctgattctggtaaggaaaactctctctcccattttaaattgtagggtgatttcattttgagacgggtcataatctttccctgaagatttaattaaaaaggttgcaaatcggttaatatctgatctatttgggatgacggaggtttctgtttctccaagggtttttttgtgccataccttaaccgattttccggggtgggtgcagagaattctagtaatgtttgggtcagcaagaataacccgaatccattttacaacatcctgtctgaaagtcagggctgtatacagaagatggtgttttcggtccggaatatccggataattcgtatgtaaaaatcctgaaaaatcattttctgatatcctgaatgcaccctcatgaaacgtctgtaaaccgcttttcttttttatatattctattgatgcctgtattgcacttttttcatgatcactcaggggaatgatggatatctggtaaaaaaaccggtcaggaggtgatacgatgattgtgacttctatcatatcatgatagagatgatatgaggaaatgatcctatcaggaacaagactccgggtgtctgaagagggtttttcaatagtaataatcaaaggggttttattctttttctgccctgaaaaaattattttcaaacccgttcggagttcgactacgtctgggatagtatcataatcaaacgggcgaatcgatctgttacaaaatttttttacaagtattcgaatttcatcctcacgaagatgaagggaggtggaaatggtctcatatgtgtcgtgggttacatgtaccaagccatccgttccattgatcgctattgaactgataaaaggatcatcaatgagaggttgaatcggaccaaatcccctggaatctctgaatatataatactcaaataatttgatcttatccagggataatgatggatataattttgaagtttcaagggcgaattcatgagaaaagttttggacaaactgctgatttctctttttatcctgaaataagcgggaaaaatgtgaacgcaggaatttgatccgttcagaatcgtctcccatgagttctggttcctttacctggtattcatagaataatggaccggtctgaattattgatataattacctgagttcctgggatctgatactgggaggctaacattggagaaaaatctccacattgtttactatctatcccgtccataatttttctatgatggtatgcgaataatttttcactattaatattaaaaaatataaaatcttattaatttttcaattatcaaatttttctataatacttagttctatgaattcaaaagaattatgattaatcatctcaatatacatatcattgaaagaatatttctctacaagttatctaataaattattttttaattaagaaaaattttttgatatagaaatataatgtataccattacagagatgctgtgaaaaaatattgggcaagactacgttcttgtattcctcatgtataggtatggcgggtatactaatcattgatgatgcggatgaagatctgaaaagagccagggaaattctgagccaggctggatatcggatcaatggcatagcaaaggatggagaatcaggtctgcaacaatattttgagagatctccagaactggtaataattgatctgattcttcctggcatgaatggtattgatcttctgcaaaagatgcgggaagctaatccatcagcccggattattctgtgtacttctgcaggtcagagtccggttattgatctggcgatgagatctggtgcgaatggctatgtcgttaaaccctatgatccggagatattactctctgcagtacggagaatactgggcagtcccggataacttattaattccctccttcgattagttctttttgctgatataccttgtatttactattatcagagaaatttgaacttataatttcataaaaaccagatactgtgctcagaacaatcaaagggaacttatgaatgaaagttagctcagttcatgcaatggaatgggccggtgccaggatttgtacgagtgataatatgagtgctgctcttaaagacgacgctctgtccgtgcatgaaatggctggtagtattggttttagggcacccgctcccagatgaagtaacccactgcatataattgtatatctctactgatattaatattatctattcatacttaaagattaattgtaatacttaattcaacacatccatcaattatcataatctctttgttgttatcactctgaatcaatcattatcccagggaatgggtgactcgcattcctttatacagaaaagacataatctcccagtgaacatatgacttgggtacctgatatgacagacaataccattcagggcaaacgtgaccctgagtatctcattgagatgtcagaatatctgaatgcccttgcaaatccggtccggctgcagatcctctcctctcttgaaacccggcccatggaactcaaggagatcgccgctataaccaggaccagctatgaaaatatcaggaaacatattgacaaactccttctggctggtcttgttagaaaagacgccggcatgagctcagagactatgaccggaatccacccggtatggaaatattcacttgcaccaggcgggatggaacagatcataacgaacctttcgatgttctcaaaagtatcgttgatgatcactcatacagatcttgcgacacaactgagtactctccgaaaagacattagcacacaatttggagtaacttcaccctgtctctatctgacaaccggacctgaagaaggcaaggttttttctttgaatggtgataagatacctcttggccgggttgatccaaccgatatgagtttttcaaagatgcagagtagtgttgtgatgctgagttcggagtataaatcagtctcccgtatcagccgacctcatgcacgtatctaccatggaaatgtatgggagatagaagattgtggcagcacatccggaacctttgtcaataccgaacctatttcaccacatacccggcgaacaataaccgacggggatctcatcatccttggaaccggcaatatgtcggcacggttcctcttcatcaccgattaaataaaaaaatactacctgaaatgatatgattacaaaatccattctctacaatatttttatttttatcagtctccttatcgttcttgccgtccctgtatcctctgaatccttaaacacggatcttgtttggaaaaataacgatttcatagataatatcggtaacagatctccctatcctgaatccggaactttttacccgccacagtttactggtggaagaggggtcccggaacctgaacctatacgccttcctttcgagagctggcagttaccggccgtgtccataggagtgagtctgattattctgatcatcatgctcattgccggattctcaatcgggggacaatatcactactcatcttccaaaagggcgggaatcatgatgataatctgtcatatcatcagcgccagtctcattggtgcttttatttttatattatatgggctggggtcgtttgaaggtggaattgatccgtttatacataccatgtatgcaacgtttggcatcctgttttatcttgctctctcatcgataattcaggcagtatcgctgttcagaacccgtccccttgttcccctgcaccaggcacacatcctcttctccgttatagcaataattctccttctctcagtccgcatacccgtaaacttcgcactacaagtaaatattgtgaccgctctgacgattattactcctggtgctgccttctcgcttattaccacccatttcattcataaaaaagaaggaaccggtcttggaaccagtcatgataaaaccatcacccgttctctccccctggtatctgctgagctccccccctcatttcctgaaagattaacctcgaaatatcatgacatttctgttattggaagcggggggatggcgattgtatatcgtgcgataagaaatgctgacgggaagactgttgcgcttaaaattccattctctgctgatgaaacaagtggaaagacctttttgaatgagatgtcagtctggcgggatcttacgcatcctcacatagcacaaattactgatcagaacatattcccggttccctatgttgagctggagtacatcccaagatccctgaaagatattacgcttcccgtatctcctggcagggctcttactatcatccggcagatagcctctgctcttgcgtatgctcatgagaatggagttattcaccgtgatattaaaccgggaaatgtcctgatcgcggatgacggaacggtaaaacttaccgactggggtctttcccggttgattgaacgggttgatgatacgagaaataccagtttctcattgttttatgcaagtcctgaacagttatccccggaaaaatatggaaatggtgatcaaagaacggatatctatcagctggggatacttttgtatgaactgatctgtgggacgccaccgtatgggagttcgaatattggagagttatttaccagaattcagaagaatgaatatatcctcccttcagaagtgaatcctgcattaaaattctgcgatgaaattgtttccaggtcattgcaggctgatcctaacctgcgatatcagaatgtaaaagagtttattgcaatgataaatctcatctcggaatcgtaagaaaaaattatgctggcatctcctgcatttcaaacgcttccccgacccctgctttcaggctgcttgcagatactgcataggttttaccggtatagagtatcccgtccagcatcccgctttttgtatatgtccctcctttgagtcgttcacaggtgggatcaccagagcaggaagtaacatccaccttgggattgctgaatgttatcgtaaggataagttgatcacgtccggtttttcccccggcggtttttgaagagaagatcatgcattcgttatcattgcatggattccatctgatctcattccgatctctgataaattcaatattctgttcctgtctgaccataccgttttttgaagactctccttctttcatcagggacacgcggagtatatcatcgtctcccaaatctgtcagatgaaatgtaatgacggaattatctgcgtcatgagtatctgccgttaccgtcccacagagaaaaacgatactgagcaggaacattcccaggagaagaattctttgatagaatcccctttcaatattggtgaaaatcatagatggtttcctgtatttataatgatttgatcattggtactgataatgaatgatgaaccagatggttggatattgtacttgctggtttcgtgatatttatctctattcttatccgatacgtggtgactgaacatcagatcttcggcattcgatggtctgaatcaggagattgagtatgaaaaaagcatcgaatatcatcgtttctttgattatcacactggttctgagtgtgatgatctgcagtgtttttgcagaggatacacatgcagcacctccaaatggacatccgaatggtggctttgacaaaatggttcagaacctgagtgaacagggttttgatgtatcaaagatccaggctgccattgacagtggtgataatgatactgccagaaaactcctcgatgagttctatgctgcacacccggaagcgaaacccaagcgaccggagatgagtgcagagcaacttgcaaagatcatccaggaactgaaggaaaaaggaaaggatgtaacagcaattgaaactgctcttgcaggtggaaatacaaccgctgctcagagtctccttgacgagttctggaagaataaccctggtgaacgcccggcccctccgaaccaaagtgagaagccaccacagtaggaatggcgttctcatccggaccatatttcatttttggaaataattatgacagcatggtttgacccacgcatcacgtacaaatcagataccatttgaacactattttacaaatataattcacatgatttcgataactcctttcgtcatgcgaaccagaaataatgagagaaaatatttcaggcatcacattccctgaggtcttttatgaatgagctacatattataccggttgttcaaaataaaaaaagttataaatggatttcaaatctttctgtaatcgcgattctgctgattatgctcgccggtgtcatgacatgttctcagccggtgcttggagctgcgaccaatgagactattgatgctgccggacgaattaccgtaactgacgttgttatagaaccatctgtgttaatgaccggtgatgtggggcttattacgtttaccgtggaaaataccggcacttcgaatgttgctattactgatgcccagcttatctcaaaggagattgtggtcctgaatagcgatgtctataaaagcagcaggacaatcggtgccggaacaaggacaaaatttacctttaccattcttgccaaccagcctgagaatatctactatccggcattttacatcaattataaggatgcgggaagccttcgatataatgttcccatccgggtagaagagccccagattgcggtatcagtatcaggtatcccccaggtatttacgagtggcgtaaccacacgactcacgctcctgcttgggaatgcgaaaagtgtaaacatgaccgggattaccattatcccatccggagatggtatccagtccaaccggagttcagcattcatcggagatctgcctcctcattctgaaaaagcaatcccctttgagataactccctcaaaagagactgacctcacctttaacatcagttatacctgtggaatgaatgcccatgaaacatcgtataccattgctattcctctaggcaccgataaacttgcagctgatcccatcataaacaatattgaggtgacatctgggtctggcgggaatacgatcaccggagatgtatcaaatgccggtctttcggatgcatatggtgttattgttgcgttagagagtgctgccgatgaatccggaaacccgaatcagaagtatgttatcgggactatcacatccggggactttgcaagttttgagatcaccgttcctcaaaacctgaaatctgttcctctcgtcattttatacaaggattcatcaggaaatcagttctcgaagaacatctcgattgatacaaaccaggtcaatggcggatttggttctgcaatgaacggggcttctggcgggttttcagggggtggcaatccaccatcaggagctccatccgggcaggcaggagggtctggtccgtctggcaggtcaaaccccatgaatccgttgtctgggatgggatcaggactgaatagtctaccggtcatggaaattttatacggaattggcattctgctggttattgtaatcatctggaagatatggaaacgaatgaccaatggacggaaaattaagatcagtttcaaatgaccggtgacgatatggcagatgaagtagttcgtcttgagcatatcaccaagatatatccccttctttcgggagatgtcatggctcttgatgacctctccctctctattgaaaaaggggaatttgttgcaatcatcggcccgtctggatcaggaaaatccacgctcctcaatcagttgggttgtctggatgttccgacctccggagatctgaagattggtggaaagagtatcactcagatgaatgattatgagctcacccgtctccgtctcatgacaataggatttatctttcaaaaattcaatctgctccctctcctttctgcgtatgagaatgtggaatatccatatacactgaagtaccggaaaaaggacaccagcggccgggtttcaaaacttctttccatggtcgggatcaatgaggagctagccaaacataaacccagtgaattatccggagggcaacagcaacgggtagcaatagcccgtgccctcgttaataatccaaaaattctcctgtgtgatgaaccaaccggcaacctggactcaaaaaccggtgttcttgttatgaagatcctgaaaaagctgaatgaaaaggggaaaaccctcattattgtcactcacgatccaactattgcagaacaggctgaccggataattacaatacgggacggaaaaatcgtccgggatggttcgtaatgaaagatattatctttgctatggctgtccggaatgtcagaattaatctcctccggtcaattcttgctgccatcgggattaccatcggtatcatctctattgcttgtatgggcatgctcggatcaaatatgaccgcttctgtaaccgagtctctctctgctatggctgataaactgattgtaagtccatattcaggaaagggaggtgggggcggccctccgggcatgtcttccggaagtgacaatctgacaaaaagtcagtataaaaatatctacaagattgcgagcaaatacgggtatgtatatggggttcattccatccgtgcgaaggtgaaaaaagggaaagatgaatggaacacacaggtctatggccttgaagtcagtgacatgaagaccatcctcaataatcttacatccggaggttacccgagcagtgataattccgttctcatagggtcatcatttgctgaagataatgatttcaaagtgggaagcaggttcaccgtgggaggttcaggagtgaaggtgtcaggcatcatcgaaccgcggggtatgtccatggatctgagcactgataatgcggttattttgacgaagaatatgtacgaatctgcttttggagcaaaggatgagtacaaccaggtcaatatcgtattgcatgatataaatgatgccgatgccgtatccaatgatattgactcacagatgaaccggagagaagagacggtgcgggttcaggacagcagccggatggtctccatgatctcttcctctgtctccacgattactagttttgctacacttatcgccagtatatccctgcttgtggccgcagtctctatttttaacattatgatgatgtctgttaccgaacggatacgggaaattggtgttctccggagtatcggaacacaaaagaaagagattctcaggatgtttgtctatgaagctgcattaatagggattcttggtgcaactctcgggatgattctcagtcttatcatggggtatttttttatccatatcatgattggaaatacgaaatatttcttcacttatgatagtctgatccatcttccatatgctatggctgtcggtcttatcatctgtattctgtccggtttataccctgcctggaggggagcccagatggacccgatagaagctctccgggcagaataacaagaacacacaaccatctggttgaatcttccaaccagtcatatcctctatttttacataataatccaatgacttgtcatgtgtacctggtttgaggtacagaaagtaaatccggtattttccaatggagtatttccccggtgagatgtctgaatcgctatgatctgtctgactatgtaccctgccaccaggaatcatccgatcacaaatgagaagaaccaatactccccgtatcacattggctctcccgtacatcagacatatgtcatatgaatgattttgtatttcaatggaagtaatccggaaataattggataatacctgatttttctataatttctttacttttcaagtatgaaatggtcatcattatggaaaatttacaatcggaacaaggctaattaaaagaacatattggtctttttgttgatgataatgaaaataattttcagatcgctgccaaaattgttcatcaggcagggtatcaggtacttctggcatctgatggaatgagagcaactgatcatattacgaaagagatggcgaagtttattgtataatattcaatggctctctctttttcattcatgctatctaatacactatgtaaatatctatggatataactttatgacaatatttcagaatttaataggtaaaactaacctcctcacccctcttccggatactattcagatacttcccttgagtactgagtattacaaagcagctgctcaactctattcggatgttttcatatctgatgagccgactacctatcttcatgcccctgatccatctgtattcatccggtatgcggagatatatgtcagatctctcattccgaagaacctgagtttcattgccctggacagcgtgaccggtgatatcatcggttttatcttctgtcttgacctgaaatcggatatctcggatgaaggggaggagatggtccggttcctctcccactttcatgaaacagtcattctcatcgatgaacttgaacaccggtttttagaaattgaagaactttctcccggagaagcactacatatcttccagatcggggttgataaacaataccggcgattaaaaattggctgttcgcttatacatactgtggtggagcatggcaagaacctggggttttcaaaagtcattgcagattgtacctcttctgcttcccttcaggttttttcctcctgtgattttgaactggctggatgcattgagtatgatacctgctgcatcaacggggagcatttttttaccggtcttgacggggggatttcattggtcgtaaaaaacctggttcctctcccctgaatatgaatcgatacttatgagtagcatgtagttcttatactatcatgagggaatgcctataaaaattgatgacttttgtcaggtttttatcattaaatcaaaggtaagatcactaatatttttcattttattaggtgtccttttagaaattattgttcattattatctgaagatcccatatgcgtatactcacctgttttacctgattattattcttgcagcgatctggttcaaacgatatgcagtatatctggcatttttctttggcatgcttcatatctttgttttttatttgaatgagggttttctctcatttgaaccagtattgcgtgcgattatgctctgtgtcattgcatttattgccggctcagtggttgaatgtatgactcatttcagagatgagctggcttttcagaatcaggaacttgaaacgacgaaagaagcatttcgaatggcaaataagaagttaaaccttctttcatccatcacccggcatgatattctgaatcatctgacctctcttcttggatatatggatatatcttaagatatgactgataatcctgcccatcgtgatcttatcaaaaaagagcagcagattgctgatgcaattcggcggcaactggaatttacccgtaattatcaggacattggtgtgaaagagccaatctggcacagccttcctgagcagtttgaagagatacagaagactttttgtcatgaatccatacatctttccagttcgatgggaatgattcagatctatgcagatccattgtttccccttatatgccataatctaatcgacaattccattcgtcatggggggaagtttcaaaatattctcttctctacccgaacagaaggtgataatctggttattgtgtacgaggatgacggttgtggaattcctgtcggtgaaaaagagaaaatatttgaacgcgggtatggtaaaaacacggggatgggtctctttttgtcacgtgagatactttctatcaccggtctgtcaatgaaagagactggtgtattcggaactggatcgagatttgaaattattgttcctccggattgttaccggtattatcaggaatcttctccggtttgagttattatttgaagcgttcatcaggtattattcacgaatttaaatcgtcccttttgccagacgatccgagttgtaaggtttcctctgggcatttttaatggagtgatccctgcaataaccatcgcccctcttgcagacctgcttcttggcagactggaagagttctgtgctccatgattttattaaccggcgaacagggtgtgatgacaagaacgcggcaaacctctctttttgaatgatataccataatttctataaagttgctaatcatatacagaagtatgtcatggcatgtcatggcacggtgaacagacatgaaacattgggttccatacagcctggtaatgagtatcgtcattatcggggcactcttattctccgggtgcaccgagcagcctgcttctgaatctgccgaatcgattaagatcggagtggttgcgtcaatgagtggtccggcgagtacaaccggaaaagacatctggcagtctgcagaactggcagctcaggagatcaatgcacaaggcggggtctttgtgaaagatctgaataaaaagatcccgattactttggtccagggtgatgatgagtcaacccgtgagggaggcataaaagccgtctccaagctaatcacccaggataatgttgatcttctggtcggggggtactcaagtgcggttgtgtcagcccaccagtccatcgttgccgacaataaagtcccctatatcatctccgggggttccagcacctcagtatcccatcgtgatgacatcgataccagttatatgttcttccaccgacccaacacagatgattcagccaaagctagcatccttttcatagatgaaatggtacggccggagatttataaaaaattcaatcttcccgatgaccgtccgctccggcttgcacttatctttcaggatagtccttttggaaaaggacaacagggagcggtcagaaatctgacacaagacttaaacctcccaattgagatcgtggccgaagagacgttcaagatgggagagtctgatttcaggactgctctgacctcggtaaaagcgaaaaaaccggatatcatctatgcggtcaccttcctgaatgaactgatcccgctcacccagcaggccaggcgggatgtcggtcttgatacactcatcctctcaattgagaacaatgatgaccctgattactattcaggcgttggagcgttaggggactacacgttgatggagagcaggttctcaccatatgccatcccgaaaggcagtacttctgaaagaacgaaaaaattccttgaggatttccagacaaagtatggcgggtttgccggaatgatgggtgctgcaacgtatgaatccgtatatatcgctgcaaaagccatcgaaaatgcaggaacggtacagaaagatgcagtccgaaaggctctttcagagatttccatggaccacatgattgaagtgatgaaagatcaggtgatccggttcagtcctgattatcaggagagcagttttgacctgtatgttgaacagatgaagatggatccggctgtaggagagatcagaccacatatcgtatggcctgaatcaatccgtgagaccggatttgtgatccctgactggtatcagccgggatctccctgatcacatttttagaagaaggatcgcaggaatggacctacatattgacataatcacccaggttctcttctggggattatacaccgggtgtatttacatcctcctggcaacagggctgaatcttatcttcggagtcatgaagattgtgaactttgcccatggggaatttcttatgctgggaacgtacattaccttctttctcttcgttatgagcgggttcaatccctatgttcttctctgtgcctcaattccgcttcttgtggtgataggagttatcgtagaaaggctctgtttcagacctattctcgggactggaaaactgaatgagatcttcgtgagtatcggactaatttatatcattcagaacctggttgccaggatatggactgatgaatggaagactatacagagtccgttcagagatatcagtgttgatctgggagttattcaggtcccgcttgattatcttattatcatggcggttacggctatcctgctcatcagcctgtatatctttcttcatcacacctggaccggccaggcaatcagggctaccagtcaggacaggaaaggtgcgatgctgatgggaatcaatgtcgagcggatggatatggtaacttttggcattggtgcggcccttgcaggagcagccgggacactctgggcagtcagcggccaggtctttaatccgtatatggggtccattccggccattaaggcatttgcaatcattattctgggaggtcttggcagtattcccggtgcaattgtcggaggtcttgctgttggtcttgttgagaacgggactgcttttacccttggtggtgcatggaaggatgctgtatcatttattctcctgatcattgtgcttattatccgtccaacaggtctctttggggaggatagtgaatgatccctcagtttctccaggagagaagatatcagttcgcggtgctggcattcatcgtggctattcttcttccggtcattgtgggatcaaaccagtactaccggacagtccttatcctgatgctgatttttatcatctatgcgtcggcctggaattttcttactttctcaggccagggctcgctcggtcatgctgccttttttgggctgggcggatatttttcatctctcatcgctattaactccggtatcccgctgattatcgcagtttttgcaggagcatgtgtcacagccggaattggtgttcttatcggaatgacctgtgtaagactccgggaatggttccttgccatggtgacattcgggtttgcggtcatcatccagacccttattgtgataagtcagctgagccccatcaccggcggatgggatgggtttgcagttccaaagcttatcccttcatcaattccggggtcaccaaaccttgagtactatggtatccttgcaatcgctgtcggctccattctggtctttcatctgctgctcaaatcaaagattggacttgcacttgcagcaatccgtgagaatgagatggaagcgaaggcatcagggataaacccggtcccgttcaagctctttgcgtttgggataagttcttttatcacggcaatagcaggggcccttgaggtatgtcatttcggatacatctctcctgagatattcgggactgatatctctttctggccgattatctattcaataaccggcgggcttggaacacttgcagggccgatcatcggaactattgttatcagtcttctctgggaaggactaaatgctctcggctttacgtatgagcggtttattgtgattgggattctgctcatcctgacgatcatattcctgccaaagggtctggtcagtcttccggaacgattacaatatttaaaaaggataaaaacgggagatgaaaagtgatcacattgatcacatgccaagatatgcttcttttacatggggatcatgtaacatcttgtctgcaggtccggagaggacaattcttccattttcaatgatataggcacggtgtgatatctcaagggcccgtttcacattctgctccacaagtaggatggtaagcccttctttattgagtgcattgatggtatcaaggacagtatgaacatatttcggagataatccaagtgaaggttcgtcaaggatgatcatctccggaccagacatcaggcatcgcccgattgcaagcatctgctgctcaccaccgctgagtgttccggcatactggtcctgtctctcctgtaggattggaaagagggaatagatgtactcaatatcaaagtccttatgattcatataggatcccagcatcaggttctcccttacggtcatctttccgaataatttcctcgtttccgggaccaggttcagatggtgatggacaatctcatacgttggaagtccggtgataggcgtatcggcaaaggtaattgttccactggatgcaggaacaaatcccatgactgaagagaccagagttgtcttccctgatccattcgaaccgataagggtgactatctccccttttttgacctccaggctgacatcccagagaacctgcagatgggagtaggagacggtgaggttttgtatgttcagcacttagtgctcctggaagtggtattgttctccgaggtatgactcgatgactcgctcatctgcagcgacttctcttggagtcccttcagcaatcttttcaccctgatccagaacaacaacacggtctgatacttccatgatgatcttcatcacatgctcgatcatgagaatggtcaatccctcatctcgaagggaccggatcaatttgatggcctctttcccttcgcttggagttaggccggtcataatctcatcaagaaggagcatttttggttttgatgccagggcacgggccagttgtgtcttgcgaaggtcgatggtattgagggtaccaagcgggcagtccagtttttcatccggaaatccaacacgctgcagacattcaattgcttccacctgggcctgcttcataccgggtttatgcccgtttccatagagagcactgatcagtactccttcctttgcggaaagacctggaaaagaacgcgggtgctgaaatgtttttgcaatacctctcttacatatggcatccagagtgagccgggtgatattctcctcttcgaaataaattcctccggcatccggtcggcagactccggatatcatattcaggagtgtggtttttccagccccgttcggcccgaccagcccaaggatctctccctccctgagtgtcatgtccacattgcggaccgcctgtagtccgccaaaagatttggagacacacttcacattgagcatatcgatcaccgtgcgatgctatgtcatgatatatgttagcatgtatcataaatctatcattcagtaggaggatccaggtgaagtgcaaaaaagtatcaaaaaatagatgccggaaaaatgtaaaggggtattcaggtggtaaatctacccatagattgggaaatgcggtctattgatgcagttgcatcggtgatgactctggttatctgatcaagggctgctgaagcctcttcagttgctgctgatgaatcaaccgcttcttttgccgcctgttctatgagatttccaagttcatgaacgctggcgcttatctgctcaaccgatgctgcctgttcttcactggcaccggcaacctctccgactctgatcgagacattcgcaatcgcctctgcaatcttgttaaagacggtcagggtctcccgtacagcggtatttccttcatcaacatctttcagtgagtttttcatggattcggtaacggcacgtgattttttctgcaggtcggtaatgaggtttgcaatcttttctgcagactgttgtgactctagtgccagggattttacttcatcagcaacaacggcaaatccaagtcctgcatcccctgcacgagctgcctcaatcgctgcattgagggcaaggaggttggtctggtcagcaattgagctgataacgttgacaatggttccaatatcctccatctgctttccgatctcaccgatgacatgatcagtctcattaaaggagcttgatatcttctgcattccggcatctgtccttccgacaagttccgctccctgtcttgagaggtcatcagtctcctgggtgagattggccacttcatttgcctgggttgcaactgcagatacggtggttgacagatcattcatggcctgaagaacctgattaacgcctgctccgctcttttctgacagatcgctgacaacgcctgcgttatgggcaaggttttgtgcaccggcggtcacttcctcgacacttgcactggtctcttccatcccggcaaggagtgaatccacttccttctttacctgcccgattgccctgccagtttcaataccgatcttattcagagagtctttgaatggtatgaaatctccttttactgaaaccttatcactaaaactagcagtgaagtctccgaacgcatatgcaccggcaagattcatggcttcattgaccgggccgatgatgttttcaagggtgttgttgattccggcgatgatctcacgatatcctcctttaaatttgtctgcatcaccgcgaatgcttaagttcccttcttctgcagcatgtgccagggtttttgtctcttcaatcagatcactgagcgtttctgcggtctccttgagagcaggaccaatctcatcacgatcatccatgatcggaacagaggttactttttctcctgcggcaatctttttcataatcccgataacctcatgctgcaggttgtttgcaaaagtatccattgttgaagcaaggattcctatctcgtccttccggtccatggtgagccgcatacctaggtgcccgtgtcccatctcatcgatcatctccacggttttacttaggggcccggtgatactccgggtcagggctatggcaaaaccaagaccgatgattgcgccgatgatggtgacgataatcatcgtcgttttcgctgcatttgcgttattatcattatctttcttaatctgttcagctactttcaggttagtttccatcagggttttcaatgcctcattacattgagttcggtaatttgccagaggggttcctgcggccagagaactaatcgcttcaggtattttattctcttttatgagagcaatagttttctcagactcaactttgtatccctggaaagcagttttaaaactttcaaaaacttttctctcttcttcattcaaatttaatttgtcaataattgctatttggtcattcactgacgcaagtacacttgctgcagaatcaaggttgacggtacgttcttccgggatcagcatacccttgtacacatcacctctgaattgggtgaatgcaccattaatgacaccaatctgctgaatcggaattaaccggtcgttatacatctcttcactcttcgctgcaagatcactgataaaaataaaaccggtccctgcaatgatgagcattatgataatagtaaggataaatccgccaatcaacttctttccaatcttcacattttccagcatttcgatcacctcatgatgttcactgtgcaacactaatttaaataacctatggtagccaaagcccctttccaaatttttaaattaccgtctcatcgggaaatgctttaattccagagcgatagaattgtggtatggtccgggatacagcatctcattgcaggacaggaatatcttggcattctctttctgaatatgagatctatgaaaaacttgcaaccggagaaaagggcctctcgagtcaggaagctgcaaccagaattctggaatttgggaagaatgagcttcctgaatcgaaaagggcatctgtattcaccatatttctcagccaattcaagagccccctcatctacgttctgatagctgctgccctgttgtcatggtttcttgaccacctgaccgatacggcgtttatcaccgttgtcatccttgtgaatgcagtaattggaacgattcaggaatggaaagctgaacagagtgcaaaagctctccaacaactctttcgaatcactgcagtcgtcactcgggacgggcatgagattcggattcctgcagaggaactggtacctggagatctggtctatcttgaagcaggtacacgggtcccggcagatctcaggataactcaggttgccgactgctcaattgatgaatcggttctcaccggggagtctgttccggttacaaaaaaggtgaccactcttcctgaagaaattcccataagtgaccaggagaatatggcgtttgccgggacaacagtagtccgtggtatctgccgaggttttattgtcaatacgggaatctgcacagaggttggaaagatcgctgtggcagttgcagataccaccctgtcaaagcccccgttgatcatcaggatggagaaattctcccagcatattgccgttgcagttctggttgcaactgcagttctgggcatcattgcggtttatcagggaatgggaatcatcgatgtcttcttctttgctgttgcgcttgcggtttcagcaatacctgaaggtctcccggtagctctgaccgtcgttctctcaatcgctgctcaccggatggccggtcggcatgtgatagtcaggaagatgacggcggttgaaagccttggatcatgcactctgattgccagtgacaagaccggcactctcacaatgaatgagcagacagcccatattgttcttctccccggacgggattcgtttcaggtcaccgggacggggtacactggtgaagggagcatccatacgcacaaaggagaacatctttcagagactgatcttcatcaggtacagcgactctgtcatattgctgctctttgcagcgaagctcagctggagagaattgatgagggctggcatcactccggtgatccaatcgacgtggcatttctagcacttgcacacaaatcgggtcttgatacgtcactgatacagaagtcagttgaaagatctctttttattccttttgaagcagaacggagatattcagcagcgggattcactgacgcaaccggggaacggtttggtatcaaaggagcagcagaagcagttctccctcattgtatcaggatgagaacagctgccggtgatgaggaggttgatcaggcactcctccttgcgaaggcagaagaacttgcagtggacggataccgggttcttgcagttgccgaagcagtatctcctggtattcctgaagatcctataaaatcgggtctccctccacttgtgctgctcgggtatatcgggtttatcgacccggttcggcccgatgctcgagagtcggttgagtcctgccagaaagcaggggttactgttgttatggtcaccggtgatcatcctgcaaccgcccttgccattgcgaaaacactggggattgccgatactcaggatcagattctcaccggaatggagatagatgcactcgggtcggttgatatacctgagttcttcgaccttgtccagaaggccagggtatttgcacgggtcaccccggtccagaaactctccattgttgatgctctcatccggatgggtcattttgttgctgtcaccggagacggggtcaatgatgctcctgcccttcggcgtgcccatattggggttgcgatggggtccggtaccgatattgccaaggataatgcggcgatgatcatcaccgatgaccggttctcatcaattgttgctggtattgaggaggggcggtttgcatatgataatatcaggaaagtgacctatctgctcgtctcaaccggagcggcagaggtgatcctctttacctgctctcttatcgcccatctgcctttacccctccttgcagttcagctgctctggctgaatctcgtaaccaatggaattcagcatgtcggtctggcatttgaacctggtgagaagggtgctatgaaccgtccgccacgaccaccgtcacagggaatattcaatcgcctgatgatcggccagatcctggtttcatctgtggtaatggggttgatcgggtttattgcctggtactccatgatctcaatcggtgttgaggagaatactgcacgaaatcttgcagttctgctctttgtcctgcttgagaatgtccatgtgtttaactgccggtcagagtacgtgtctgcattccagatgcccctgtcaagaaatctattcctggtcggttcggtaattgcagctcaggtgatacaccaggttgccatgcatatcccaattcttcaggatgtcctagggcttcagccggtcagcctgtcccagtggggagtgctctttgcagcggcatgtttgattattgtgatcatggagttgtttaaggtaatctggccacgagttaataaaaccgaatgatgtatatattattacagtgccttgcgaaacgttttggaataatcagattgaaaaaaagattattccaaggcttgcactctaaatgcactgcatagtttaagcgaatatttctgaattatttcagaaaaattcgcattattctataattcccgaatcattttttcaaatataactatcgtattattgttggataaaaaaatataagattatatcttaatgaaaaagtaactaatatgtacttcaccaattatttatcatcaaaaaatccttactgattagttatgtcaacaattattgaagtaacggaagattattttattcccttaagagaaataaaagaaattctaggtattaaacctcatgattcatttaaaattgaaattttaaataattctaccatacaattgaaacgtgtatcccaagaggattctcttatcgatctcattgatcatcctgcaatccttggtcggcctgttacctcacaggaacttcgaaaaatcgatgatgaaatttggggacaatgaatatctttatcgattcaaatattctgatatttgctaaccttggtgattcacctgaatatcccattgtaaggtcaattattcatgattatgttgagaatgatgctcggtttatcataaattccattattgtttctgaagtacattataaattaagaaaatttcttggttcagaggaatcggaaaaaagaatgataaaaatccttaattcttcgcatataacatatctacccatcgataattcaacaatacttcgtgcaattggtctttcaaaccggcagaatgtaatgacaaatgatgcgattatcggtcagcatgcccttgatgttgaatctgatggaatacttactgataattacagggattttaaaaaaattcccgagttacatgtgattggtatctgttgagcgaaacaatccaaatatctatcgctttttaaaaggtaatttttttcctatcaatgaacattctgcgaaacccgggacctgtctatggtcagttactcgttgtcattggagctgttctcataagtttatcaccggtctttgtcgttctttccggagtaagtgcgagtgcctctgcattttaccggatggcattatcccttcctccacttctcctgctgctggtctttatccggggaaaaatatggcttggtccccggcaattgggaattgcccttcttgcaagtatcttctatacgcttgatctcatctgctggcaccagagtatcctcctcatcggccctggacttgcgacgatcctggggaattttcaggtttttgtcctggcagcgttcagtgtccttgtccttcataccagagtcaccccccggctgattcttgcaatcccggtctcgataattggcctgtatcttatctgcggggtgcaatggagcactgcttctgatggttttcagatgggagtcctgcttgcactgacaacagcgttctggtacggcgggtatgttttattcctccgtcttttacagacttcatttgatctggaggggaagattgcgaatctgtgtatgatatccatcctcaccaccattattaccgggctcgtggttatcggatcaggtgatagtttcgacgtcccaagtgttgattcatggctctatcttgctgcttatgccataatatgtcaggttattgcatggctgctcatatcagcaggacttccctttacggttccgattaaagtcggactcatattacttctgcaaccagccggggcttttatctgggatattctcatcttcaggcttccgtttacctgtgtcaccgtccttggtgttgtgctaacacttggagcgatatatcttggatcaacaagcaccagtccgggagaaaaatcagaatcctgaccatgagttcatcaccagaacacctcatattgaggatacatctatctataccagagataaattagaaactatttattcatacgacccttcttactgtattgaaaacagattttctaaaaaggtgataactgatgtttacaaaagtcctgataccctatgatttctctgatgacgctgaatacatcatcaggtgcctgaaaaacattccccggatacgtgaagttatcctggtccatgtcaccagaagtctgtaccttgtctcttctccggaaagggaaaatcctgaggctgactatgcccggctgcgacttgaaaaggtacgggatctgatcgagatgccccggtcaaaagtccggatcatcgtagaggagattaccggaggagagatctctgatgcagtcatccgggttgcagaacgtgagcaggtctcactcatcctgatgggcagaagagggcggggagtcatcgagacaatactgctgggaagtacggcatgggatattctccggttctgtccatccagtcttctcctgatccatccacctgaaaacgtttcagagttctcacctggtgtccgttgtccggatatcttcacacgggcattggtatgtactgatttttcagaacctgacattgaaactcttcttacagatattcttcccctggtttcatctgtggatctcttccatgttgtctcgaaaggggatacagatgaggagataaatcgttcggtgatggaagcagaagagaggttaaaaagtattgtcatttcctgcccagagaaatccattccggtcagaactcatgtcaggattggtgatgctgcagatgagataattcggttctctgaaaaagaggatatatcccttatcgtggtaaagtccaccggaacccgggggttcgtgcataaaatcattggtggaacaacagaggcaattgcacgaaatgctaaaaaacctcttttcattctccgaagatcagaataattttaaattttttcgtgtaatttttttgggtttattatatatttcaatcgctgtaaatcttgctggagatttgaagaatgttcatatcgatactttattatgataggatatcgttgtacattttattatcctgcactgcatgaggatttagagtaaacatcgtgaaacgattggtattctaaaagtgaacgctcattggaattcatcgtataatcagaatttatgattatatgaagaaaatttgcattatacaattacgtatcctatcggttgaaaaatctccattatttagactcatatgttatcagacttcaaatcccagtttattgaaatctctaaagcaataactccaattatattggtcattttaattatccatttccttttcataccagacttctctatatcaaatgcgttggtgttgatcttaggcagcctgatggtaacactgggtattgccctctttctcgtcggagtaaatgtagggttgattccgattggaaatgccataggttcagacattccccgttccggttcaatagtgatcattctcatgactaccttttttttagggtttttagcaacaatagctgaaccgaatgtccgggttctggctgatatgattcagatcgtttccgaaaacagtatagagcggctccaatttattatggtgatatcagttggaggtggtttttttattgccacctcaattttcagaattatttataatgtccccctggcttaccttttttccagcgggtatcttctggtattgttgcttttattttttgcacctccagactatgttcctatcgcatttgatgcggggggtgtcaccattgggtcaattaatggcccgatatttttagcgatgggtattggtgttacttcaatcctcgggggtcgctcagctatatctgatggatttggccttatagggctcgcatcactagggtcggttatttcaattcttattatggggattgtggcattatgatttatttaccgattgctgacaatattgatcatgtcatcgttgacgtcattcaggcgttgtcaccattggtcttgttttttcttattttgcaggtcctttcactgaaactgccgaaagattatgttattaatctactgaagggacttctcattacactcattgggatggtcctgttcttccagggggttaagatagcatttctcccggcaggtcagaggataggagaattatgtggaactattgagcagacctggttattaattccatttggattcatgctgggctttttatcaacatatgccgaaccatcagtccgggttctctgttaccaggttgaaacctcatcaaatggctatattaagggctctctcatcctgtatgcactttcaattggtgtagccatatcagtgggtgtgggtatgatcaggatactgtatggttttccgtttcttcccattatcttcggtggatatcttcttgttctcattctgctacggttttgtgattctgactttattggaattgcatttgactcaggcggttttgcaaccggtccgatggcagtcacctttcttatggcatttgcggtcggcgttgctgattctatgggagggagagatccactcctggatggatttggaatgatttcattaatttttctcactccgattcttatgttattaattattggtattatctttaagatgaaaaagaaggagatgtatcatgattcatgaaggatgtaaaaatctgattgtgacgattgtcaaaaagggatggtctgagaaggtaatccaggcatcacgggaagctggtgcatccggaggaaccgttcttatgggaagggggacgggaattcacgagacccagtcagtcttcggtcttccaatcgagccggaaaaagagatcattctgacagtggtggaagtggatcagaccgaaacgattctttcagctattgaaagagcagcagaactcgatagtccgggcatgggcattgcatttgtcataaaccttgaaaaaatcgctggtcgggttcatatggcctgtggatgccctgataaaactcaatgatggcaatttcataggcctcatttgtttctctttcatttaaatcaggatttgagatccggttataggaatctcttatctttcacaatatccctgattttctacacgttatgcagattttatctgttgaatcaatgaaagagattcgtttgagagataatgcctggtgaatttacctttcttttccagacgtatggatccctcatgagcaaggtcctgcacagcccgggtaaccgttggaccggcaataccaagctggtcagcaaggtctttcctggtaattcccgggctatgtcgtatcaccttcaggatcctccccgtaaggcctgatgcatatcgtgcgagaaataattgagcatcctcggaatatgtattgtggttttcgaagaaatgatctgattttccctgataaaagatggtaatccatttttcttcagcaattcgatccacgtggtaccggatagtattttcattacatccggaattcctggcaagattatgaaggtcaattcctggattttcgcatatcagtgcataaattttccggcggataggatgatccagaacattttgaggagtaattcttcggtaacccctgaattcggccctcaaaccagaaggggtacaccataggtctcgtataaaattcgggattatccatctgacatcaggtgctgatccctttttttcctgtccttcagtgttctgtctcccggaatttctctcgtccggttcattgaacgacactatccggggttccgggtaacagcactccagaggaatgccaagagaaatcaggaaaaagcccaatgcaaaaccaaaaccggttgattgcataattctaattattattggtagtggaaaggtaaaagaattctctcatgtaatgtttgatcccaacaggtagcttttcagaccagagtgagtatttagaataccggataatatgatattatcggtaaccaagtgttactgaatagctctggaggtgagtttttcgcattatcttttaaaaccccctcacaaggtcaaaatctgtacatagttatttaattacacaaatcacacatcaccccccggttcatctgatagccctgaaaaaccaggttaatatcaggagatcagatggacatattttttaaaggtttacctggtatggatagttctgtgaaagagtcgtaaaaagttaaattgtgtccctatttagaaatttttagaacctgggataattttttttaaaaaatagaaaaaggataattaataaccacgaatttcttcgcggaccttctcgagattttctatccttttttcaagtgccggatgagtagaaaagagagcagcgagagatttacctgatattgcaggaataatataaaatgcattagccccttccgctgctgctctggtctgtacaggtacccgatccatctttccgctgattttttgcagagcagagatgagtgcatcaggatcctctgtaatatatgctgctccccggtctgcagcaaattcacggtaccgtgataatgccatcatgagcaacgttgcgataacccagacaactgctgcaacaatacctgcaattatccatgctcctccctgctcacggttaaatattgaagcaaataggaaattattcataatcatggatgcaatcatggcaagaaatccagcgacggtcatggtaaggatgtcacggtttttgacatgggcaagttcatgagccagaactgcttctagttcatttcggttcagcgtcgccattattgaatcagtaaccgcaacaactgcatggttcgggcttctgccagtggcaaaggcatttggcatgggagattgcatgatggcgattctgggttttgggatctgtgcaattgaacataaattttctaccgtgcggtgcagctcaggatattcatcattctcgatgattctggcacctgttgtcatcagtaccagtttatctgaaaagaagtactgaaccagacccattcctacagcgataactataatgaacacagaaggaagccccagagcaatgagaactcccataaagacaagataaacaaataataacagaatccaggtgaaaaagatccttcccgacaatccggtgtcacgtttccatttcatagataaactctgataatacgtttatctccgaatgggataaggattcatcatccgataagctacctgaaccgaatgacctgttctgttcttctgaaaatcgatagctcactgcagagtatctgccacaattttgaaattctcagaagacatgagtatggtatcaccatgatcccaactcaggacctggaacgttttggaactgacggcttgtcttccgaaacggttttggaatccagaaaactttatgggaagaacgaattaactcccccgaagcggataccggtctggaaacaatatcttgaaaaatatcaggatccgatcatccgcattctgctcgttgcagtcgttctttccgctctcgttgcattactagagggcgaaagcctcattgatacccttggaatcgctcttgcagtcatcctggcaacaacgattgcattcctgaccgagttcaggagtaaccgggcgtttgatgcattaaatgccatgcgtgaggataccggtgttaaagttatcagagatggcagtccgggcagcattccgatgcgggatatcgtcgttggcgatgtaattctgctggaagctggagatatggttccggcagacgggtacctcctcgttgcagctgagaccgaagcagatgagtcagcctttaccggagagagcgaaccggtgaagaaaattgttcaggattctgtcctcaaaggttcctacattaccggtggcagggcaaccatgtttgctgcagctgttggtgaccggacaaaaatggggcagattgcgtcgtcactcaccgaagggacacgacctgaaaccccgcttcagattaaactccatgatctcgcccaccttatcagtaaattcgggtacatcatggccgggctgattatcggggttgttttaattcaggattttgttattggtgttcctccacagactccgattgagatcttcagtgtgatcctgcatgcctgcatgtttgccgttgtcatcatcgtggtctctgttccagaaggtcttccggtgagtgttacggtatcacttgctctgaccatggggaagatgaccagagcaaaaagcctggtaagacgacttattgcctgtgagacggtcggttcggtgacggtcatatgcacggataaaaccggtacccttactatgaatcagatggaggttgccgcatcatctgtagaagtgcctgaaatctccagcggcctgccgaaaaccccctctgaatggataaccctcaatgctgcggtgaacagcacggcagaactggagtatcatgaggatcggttgatcaccgttggaaactcaaccgaggctgcccttctcagatggctgcaccggaccggagtcagctacactgatatccggcatgcctggccttccatctcccaggattttttcaactccaagaagaaacagatgtcaaccatctttgagtacgactcaaaacggtatatcctggtgaaaggtgcaccggagatcgttgcagccaggtgcagtcccgctcctgatctctccaatcttcatcatcttgcacagcgggccatgcgaacccttgcgtttgcccacggagaactgaaaccggatggtgaggaaccttcaacactcatctgggacgggtatgtgggaattcgtgatgaagtccgtcctgatgttccggaggcagtgaaaacctgtaatgatgccggtataaccgttaaaatggtgaccggggacagccctgagactgcaacggcaatcgcacgggagacaggaattttcagggatgggaaggtcatgaccggcccggagtttcgtgagttatctgatgaaaagcgacgggatatcgtttctgatctccaggttcttgcacgatccgagcctcatgacaaacttctcctggtcaaggccctgcaggcaaacggggaagtcgtggccgttaccggtgacgggacaaatgatgccccggcccttcggaatgctgatgtgggactggccatggggattgccggaactgaggttgcgagagaggcaagtgacatcattcttcttgatgactcattcccgaccatagagcgtgcggtctggtggggtcgggctctctatgaaaacatccagcggtttttgatcttccagctcaccatcaacatctccgctgcgatactgacatttatctctccgcttcttggttttcccccgccgtttaccatcatccagttactctggatcaatatcatcatggactcgctggcagcccttgcactctgttcagaggctcctcatcctgctctcatgaaccgaaaacccatacccagaaccgcttcggtaatcacaccctacatgaaattttcgatcctgataacggctatgatttatattgtagtcggcattacctgtatgataaccggtcttccgttcatggagacccccgaacagcaggcaaccgcgttctttgccggttttgtaatcgcccaggtctggaacgggtttaactgccggggtattaacgggatcatgcctccgctgttcagaggcaacccggtattttttgttataatgggacttattgttggaatacagatccttattgtccagtatgggggagagatctttgatacggttcccttaactcccctgcaatggatagtgatcggaatcgggacgatgcctgtccttctcatatggccgttccttcggttttaccaccagaggacaaaaaaattataaattttccggagatggaagacgggttatgagaattttatcaattctgtgcccgtccatatcaacaacttcgtattcatttccatcataggaaaaataatcgccggttgcaggaatacttcccattttgtagagtataaacccggccatggttcggaatgccccttttgatgactcttctgaacaatcaatcccggttatttcatagagttcctcaggtgaggttctcccgtcaatcagccaggacccatcatgcctcctggtaatcaggggctcttcatcatcctggtcaactctggagaggtctccgaccagtgcctcgagcagatcatgaagggtgataaggcctacaactgaaccatattcatcaatgatgactgccaggggcgatgtagctgttttaaatcgacgaatcaggtcaagggccttcatattatcaggcacgacaagaatatcctgcatgatctttgaaaaatcaacttcggtgtttttatgtgcaataagccagagatcacggattgatataatgccaataattgaatccagtgtatcctggtagattgggtaccgtgtatgacctgttctttcaattatctcaaaattttttgtgataggatcattgagattcagggcaacaatgtctggacggggtatcatcaggtctgcaatctggctgtcaccaaattcaaaaacactctctaccatgtcctgttctgtctcgtcgatgatacccgactcggtcccttcttccaggagcatatgaatctcctcttcaatcacatccggggaagttaccggtgatatcccgaagagttttacgataatattggtcagccctgaagtaagatacgagaacggggagaagatccgggtaataaggatgaaaaccggggcaacagtgcaggcaatccgctcaggatttgcaaggcctattcgttttggaaccagttctcctatgacgatggagaagtatgtgatcagaaggataataaaggtcaggctgatagcagcactataatgaccaataattggaatcgatctgaacaaaggttccagtgatcctgaaaatgttgctcctccatatgcaccagtacataccccgataagggttatccctatctgaattgaagataaaaatgaggtctgatcctcaaggagcgataatgctgcaccggccccggacctattctccgataccagttgtttgagccgcatctttctggacgaaaccagagcaaattctgccatggaaaagaaaccattggcaataatgagaagtattaaaacgagaatatcaataatggctgccataggcggttatgaaaatatacatatgcattactgtttcgagaatatttgtcttttgcatccggtttttaaggaatcatttttgtgattccccccggttggttcggggtatatctgtttttgcctttctgtgggagtactttttttctccatatcgcccacaagtacccgcacatggtccatgtccagtcagaagaagagataaaatcttcagaaattcgcatgcagagactgaaagaacgggttattttcaaaagtctcataatagatacgatcttctggatcccctcccttatccttgcaggcatgtctggttcggtaaccttatccaccgaagccatcaagaaagggaatgagatcctctctacctttttcgcctggttggctctgaaaaagatgtcacaagggggagctcatgcgtatgattacggcatgggtaaatttgagaacatgaccggtatcgtgaccggcattgtcatgatcctctcactggtcctggttttcgggcttactgtcctgaagcttctcaatccccatatgctccatgaagaggttaccatcgttgcaatgatcgtcatgttcaccggcatctgcgtcagcaccattctctggagggagaaggttcacattgcaaagatggagtattcaccggtcattgaagcccagattactctgtttaagacaaaagcgattacggaattcgttgttcttgcggcacttttactggtattatttattgaggataatccctgggaggattatattgatccggttgcatcattcatcgtcatcggtttatttctcctctccggataccggaccatatcatcctcacttcctgacctgctggacaagaccatcgaagaggaactgcaactggtggtagtcagatcccttgcagacttctttgatgagtatgaagcatttcatggcgtcagatcaagaaagtgcgggaatgatatctttattgaactcttccttgagtttgatggaaacagactgatggatgatgtccagaagacaatctatgccataaaagagtcactggagaaagagatccccaggagttcggtgacgataatgccatgttccggtaaatttggagggaaaaagcaataaattcaggagaatagaaagaattgagaaatgacctgaatgagagcaacatctcttcatcctggaaattctcatcatctcactccttttaattctttgatcggcgtggtccatttatcatcccggatagcatctggatcctgggctcccttgtcagagaattcatatatcctctctttttatcatcttgtgggctggtttttcattctccgtcatcccgtagggaccattgccaaacctcactcagtgatcctgtatggggtgttccaggtattcggtttcagtcatttatttaccttataatctccttccttttttatggcatttcgatcacaatatctccttctttttttatttattgtcgctgctctccttattataccggtcatggcaaaagatacccataacccggtaccagagtatgaaaaacagatggcagagttcttttatccagacaatgccgtatcccatatctatcatgctaccatcgaaccccactggattcgatctgatgcattctggtatgctgataccggccgtgatatgacccggttctttctggttaatatctcacagggctccagaaagaagattattgatgcaaaccggcttgcaaaagtcctgggatctgcaaccgggaaacaaatttcaccctcactcctgcccatccaagagatggaggtgtcatcagatgaaaagaccctgcaattcacctcttttggctcatcatggacctgcgatctcgtatcgtatgccctgacaaagaataaccttcctgatgagataatctctggcattccgtcgcctgataacacgaagatcgcctatgtcaatggctccaatctctggctgtatacggtaagctcaaaaaccgcttctcccctgactactgatggagttcctgattatttctacggaaagcgatctgacacggtcaggtacccggtttctgaattacgccttaattcgactcctgcaccatacctggtctggtccccggattcatcaaaaattgtaacctaccgggttgatcagcgaaatgtaagttccctttcgcttgtccaggatgcacctggtattggtaagaggcctctattgtatacctacaagttcgcaactcccggagatctgcatattccaaagtatgaaccggttgtcattgacacatcggttcggagtgtgactcctctgaaattcagggcacagcctgaggtgagtctgatggataccgaccaggatatcctgcagtggtgggatagtaccgggaatatcacctactcgctctttgtcgaacggggagagaaaacacttcggctcctcgcaggagatgcccggaccggtaccgttcgggagatactcaatgaaaccggtacttcgtatattgagtcaagccttgaatatgccggcaccccgaatattcatgtcctcgcgaatggagatatcatctggttttcagaacgggacggatggggacatctgtaccggtacgatgccaatggaaccctgaaaaaacagattacgaaaggaccctgggtagtcagggaaattctggctgttgatgaaaagaatggccacatatactttactgccagtgggaaagaagaaggaaatccttattaccactatctctatcgggtccagaccgatggaaatgatctcaggctcctcacacccggtcaggccgatcattcggtttttctgtcacccgacctcacctgtttcattgatgcctactcccgtgcggatcttccaacggttacggtactcagatccatggatggaaccctgcttatgcatcttgcaaccgctgacgattccgatcttcagagaaatggctggtctcctgctgaacggttcaccgtaaccgcccgtgacggaaagactgaactctatgggctgctttttaaaccaacgaattttgacaacacgaagaagtacccggtcattgatgtggtttaccccggcccctatactattgtcacacaaaccgcctatcccgcctctctgacctggaactctaaaatatactggacctgccagatgctttcagagctgggatacatcgttgttaccatggacgggcttggaacggcgtaccggtcaaaagaattccacgatgtcagttacgggaacctgagtgactgcggtcttcctgatcatatcacaggtcttaaacaactgcaagcacggtatccatggatggatctgaaccgggtcggtatctatgggaaatcagcaggtgggtttatggcagcccaggcaatgctcacgtatcctgaatttttcaaagtcggggtcgctgcatcaggggatcatgattgcaggttatatggttcattctggggagaaaagtatgagggatatccggttactgaccggtatctggagcaggtaacggcactcaaggcatcaaacctgaagggagatcttcttctcatgaccggagatatggatgataatgttcatccctcaatgactatgcaactggcagatgccctggaatcagcggggaaaaagtatgatcttatggtgtttaccaataagaatcatgacctgaattatgatccctattatctgaagaccatgatgaggtatttcgtcaataaactttgaggataaattttattacacaaaaaaatttttgaaaatggtcttctggatcaaccggtgagccgtaccatcgatttttggattttaattgctgcttcagcgaggataacctgcatttctgataattgttttaatgcagctgctgcctcttcagatgcagccgatgctccaactgcctcttcagcagtagcaatagatatcttgctgacttcagatacacttgcggtaatctgttccacagccgccgcctcctcttctgaaagacttgcaacctcacccatatgcagggatatctcttgtgtctgctcggcgattgaacggaatgaggcaatcgtctcattaattgcagcggagcctttggagacctctctggtagccaggtccattgcctgtaccgctttttctgactgattttgtaaagttgctataatattagcgatattttctgctgatccctgcgagtcctgtgccagagtcttcacttcattggcaaccactgcaaatcccattcctgcttcgccagcacgtgcagcttctattgctgcattgagtgcgagcagatttgtctgatcagcaatgccactgataatctccacgatcttgccaatttcaatcatttgttccctgatacgagtgattatgtctcctacatcatttactgcaccgttaattgcctgaatccctttttcagcgatcgccgctttctcaacaccctgagaggaagtagtatcggcatcatgacttaatctcgcaactgaatccaccttggcagcaaccgttgagactgatgtggaaagatcttccatggcagtaagaacctgctgcactgatcgctttgttaaatcagcatttgcctggacattttcaacattctgagatattgcatctgctcctgcggcaagttgctcaacggttgctgctgatgattcagccgattgagacagattggtgacctgatctgatatctcctgtataactgcttttaactcctgaccaacatgaataccgatctggttcattttttgttttaatactaaaagatcgcctttcacggtcaacccatcgtcaaatcgtgcattaaaatcaacattggcatatcgttcagctacccggagggtttcattcaatggaatggtaatggcatcaagcatattgttaatccctgtaaccaaatcttggtaaattccgataaattgtgatgcatcaccacgtgaatttaaatgtccttcctgtgcctcaccgataagaatacccatctggtccagtaatccattcagggtttcgatcatctgatttaaagcgggtgtaatctcatcagaggtatcatgtacttccagcttttgtgctttctcacctgatgcaatcatctgtatcgttcggatgacttttccctgcaaatcatcggcaaaagagtccattactcttgccatagttccaatttcgtctttccggttcattcccagccttaaaccgagatgtccctttcccatctcctgaatcatattcacagccctgtttaagggaccggtaattcctctgctgatatagatgccaaggataagagcaattactattccgattatacctgcaaaagtactcatcaatgaggcttgtgcaaatatggaatcagactctgtttttaaattttcagcagcattcttatttatttctttgagagaatcaattgaggcaccaatattttttcttaccttttgcatctcaccaaatgtgagtgaatcaaggacaactttttcatttccttcatcccagtatgcttggttttccttaatcagggtcttatatcgttcccagttggtagtaaatgtagtaagttccgttttttcagaatccagaaggttcgatgactggtaattttgcatcaactgatctacaagtttaatattttcatcaatttttttccgggtattctcttgttcctcaggtatgagtagatatttgtaaaaatcacccctgatttcatacagaacagcagcagctgaacccagatcctgaattgggataagccgatcattatatactgatgtcagactggtgttcattgtctgcatattagaatatccaatgaatgcaacaataccaataatcgctgcgataaagagaaaactgccaatgagtttttttccgatagaaatgttgtcaatgatagtcatgagttcctctctcctttttaaatagtattaaatccggtattcatccctgccaattattgattcccgttctcatagtatataaaatacattcctgtgagtctctaatgctattattacatgcgttcatgaaaagtgagatgcatagaactttcataaaatcggttaatagcaaggcaattcaaatattatttcgaaaaactcttaaatataatcatatactcataaggatctctctccgattgaagtgttctgaaaaagaataaatattggtggatgcctgaatggttcctattcatatggttcttgaacagatccctgatacacaaaagaagagagtgccggcatctagggaacctgcccgataatccatctttttggttcgattggagcaggcatatcatacatcttcacatccggataatcctgtgaaatcttcttccagactccggctgccgcatcataccaaagttcgagatccttatagggagtaatgcccatatcaaccggagagaaggtattctgctctgattcatagtccaggtatttttccataagtgtgagagtgtaggacaggaatgatacgatctcttctgcccgtggatactgttcctgactgatattcatcctgataagggtgtaatatgtctcagccagggagtcatgaagagcattatttatctttccgaccgggagtgattccccggtgcagatctggtatatggttgtatttacccgatcaaagaatttactatcgtcaaatggtggttcttgtgcaggtggggcaagcgggagttggacctttggaagggtggtcatgactgcatttccggttgatatcagacttaaaaaaagcaggcccgacatgaataaaaccactatacggctcataaacatcatgagacggtatgtgccaaagggttgccggtttagaggtttagaaaaaagtaggttcaggcccggaaaaaaggacctgtttggcttattttatgctggtgtatgccaggttacttctttcggaagggtgacattttcaccatatatcccagagccaagccaccaggtatcatctactgcctctacatacccaagtttcttctcaacggtattgttatgagcaggatttacataatgaaataccacaaaccctgatccgttcagtgctgcgtcacggaggttccggataaagtactcattgctcgcatcaagctcttccagtctgctctttccgattaattcggtctggagcgggtgggcaagggtaatcccgtcaaaatcataggcatagatgtagaggtttcctctgaagaatgatccgttccggttcctaaattcagcaaggacatcttcctttttattatcccgggcatattgaactgcctcctgaacaaatgccaccatttctgcaacaggtttgtccagtgaatcggatgtcatttcattgtccgtttgtaattctgattgtgattggttttccgtgaggttggtttctgtaatagtgattggttccacccttgcagggctatcctgcatatctgctgaaagggaagtaataccgcacaaaaaaaccaaacaaatgagggtgttgcaccaatgatcaatatcatgcaggatcacaaatgatcgatctctaccccttaagctatcaaccaaaatagactaatggatgtatgaacctgcatgtatcaattcccactttacatactgtgtttgcaaaaatataggaaaaacctgaacctcttgacggttttataatattcgtagcaaattctttaattttaactataccctcaaatctgataagtttttttatattatgcactaatgcagctaaaaagaattctccctcgcaattctctttccctttttgagagaaactcctaaacctcatattatgtttcatattaccaaaaactggttcgaccatgtattttcgttttcgatataactctctaccagtgggggatttcacacgtacttccataactcgtttacaaatttcctgagttgttgcttgtttctctctgttcataaaagattgccaaacaaacgtcccgatactttgcaattccggaaatgtgattatttctcccatacaaatcgcccgacatatcatttccattcgtgagatatacccatcattatctgaatattctggaatttttctttctttagaaggagggatgatgagttgaatgccataatccaattctgctaaagaattcgggtatgagaaataacctgcatcagatagtagtatattaggcgaaattgatggatgaatacccgtaaaaaggtcttcgagttcatttagcataggtattaataattttttatcgttttgctcatctgatatcattgcagcgaggataaattgattttcagaaacgataatctgcccattatacccttgaatccagccattggtggttgacattatctgactttcaggatcagtgagatttacttttgaatctgaagatggctcttttttaggctctaaaggctttctacctcgtttctttttacccgattctaattcttctttttcgcggtccagaatcttttcttcttgttttttagattcgatatcatgtcgttcaattaatttctctttagcccgattaagaacttcctttcgtttttcttttgttgaaagatgctcaggtagtcggttaatctccatatcctgaatatttatatcatcgttttctaactcatcaatttcctgtgattcatcaaaaagccgacctagctctgcttcaaggtattttaattttttattggctgataaagaggcattacagccaaattttgatccatcgagggctaggacaccgattcttgctatcccggattctacgataatttgagataattgtttaaaaagggatttgatttcttttgaattattcttcttgaaacgatagatcgttgtatggtcaggtgtaagattattggcgacaatccgatatccaatatcataatggcagcacatctcaatttttctgctagatttttctccacgaatcattgaataaattattattccaagcattgaacgaggatcaaaaaaggcagaaccgcgaccatcgtcacgatatttattaataaatggactaatatcgagaatcgaaagaatttctaatatgccataagtaatatcattttcagatagccagtccatcgcattgacagggagtaaaaattgttgttcattaccatatcctctaatcatgttatagcgatgagacatataatatattgatcttaataatatatataattaagctttaataatttatattaagctttttttgtgtttgtgcaacagcctcaaataatcaaataatgagtcatgatttatttattggatatgataatacatgggatttttgattcaggattccatttgggcatgcaatagaactctgatctgaagctcttttggaatctcaataacccggagtggacatctaatacgccattcaggtacacgcgtatatcgttctagctggtcacaaccagacatgatcttttctctctcataggactttatgcactttcatggtcattgttatggaatggaagatctgagaactgatgtacagcgcaccccatctgacaagatactgaccgatccacccttttatcttcctgaattcgaggcatcctaccggtacatcattgatgtgtatgaggtgccccctcgtgacattgccatatttatcccctgtgcggttcgaaaaccatacagtaccagtccgagtcaccggatcatgcgagctatcatcgataaggttctgcagccggattcatttcatctcgtgatctttggaacctgtggtatccttcctgcagaactggagaccatgtacccctacgctcattatcagtacatgctgggaaaagtgaaggatccatctatacaggaggattttctcaggattgaaaccgatcgggtggccgggtatcttcaaaaaacaaaagatacgtataaaaaacggattgcctattgtattggtccgtttcggagggcgttaatccagggatccgaactggcaggagtccctattgatatcatcatgccaggaaaggatgtaattaataaaataatggaacttgactgtcctttccaagaaggaagtctgaatatggaagaatatcttgaagagttctataaaggtcttgttttgattcgagactcattattgtgaatataataattataatatattaataaatgggtccttttacctaccggaaacgatccgggaatagtgtttgaatatgtgattccatagacggccgctatcgtgactctggagcctgacctaggtcagatcaggtgtcttaaatccttaaattgaatttattttcaataatacgcttaatttttggataatatgaatgaatatggtactctttccattctggaagggaaggaggggggtgaaaaaagttattcttcaagggtagagatatcgcctggatccactcccatctcttttgccttgaggacacgtcgcatgatcttcccgcttctcgtctttggcaacttatccataaattctatgccggatggcatggcgattgggccgatggtcatccgtacatggtatgtcagttcagagacgagcttctgacttggttcatatccctgtctcaggataacaaaggccttgaccgcctgtcctttcacatcgtccggaacaccgatgacggcagcctctgcaaccgcttcgtgggagaccagcgctgattccacctctgccgttcccagattatggccagcgacgatgatgatatcatcagatctccccaggaccatgatgtatccgtcctcgtcctttactgcaagatccccgactgtataccagtttttaatctggttccagtattgtttataccggtccggattattgtagacggtccgcatcatcgacggccatggctctttgatgaccagcagacctccctgccgtgcaggaaccggattgccttccttgtccaccacatctgccacaactcctggtataggaacgcctgcaaatcctggtttcataggctgtccgagcggggttgtgatcatgtgcatgccggtttcggtctgccaccaggtatcaaggatggggcacctgtttcttccgataacgcggtagtaccattcaaatgcctccgggttgagaggttcaccgaccgatccgatgatccggagggagctgaggttatacttatccggccattgctcccctaccttcatgaacattcgtatggcggttggagcggtataaaagaccgttacaccaaactcttcaataaggctccaccagattcccgggtcaggataatcaggggtggtctcggtgatgagcaccgttgctcctacagagagcggaccatagacgatgtaactgtgtccggtgatccagcccgggtcggcagtacaccagtggacatcgttctctttgagatcaaagatatatttgcaggtgtaatgagctccgacgagatatcctcctgtggtatgaacaattccttttggctggccggtcgtcccgcttgtatagaggataaagagcgggtcttcactgtccatctcctctggcgggcattcatcactgactccttcctggatagcgtaaaagtccacttccatctctgaatagagttccaccggacaccgttccctgctcagtaccacaatcttctcaacactgggagagttcttaaccgcatcatccacgatactccgcagtgggattaatttacctcgtctgactccgacatccgcagttatgacaatttttgcctgtgcatccctgattcgtgcatggagagcctctgctccgaatccggcatagacgatggagtgcactgcaccaatccgggcacaggcaagcatggcgatgatatgctcagggacaaggggcatgtacagacatatccggtcccctttctgaacaccgagttttttcagggcattggcaaaccgcatcacagcccggtagagctgacggtatgtgtagatctcctctttcccctgctcacccttccagatcagggcaagtttatttctccttccgttcttaacatgccggtccagacagtttgcggagatattgagttttcctccacaaaaccaccgggcattcggccagttccactcttttaccttatcccatggttttatccagtccagttccctggctttacctgcccagaatccatccgggtctgataaaaactctgcataggcttttttataatcacccagggcagaatttgcctgataggacgggtctgggatgtaggttttgttgtcaagtttgacatcaaagttgtcagccattgttgttccaccatctggttcatgtgggggcatatccggccggatcgatgatcatcatatccggctgaattcagatcgacaatcaaatgattgctgatcgtatgatcaatcgtgtagaattgaaagagatataatgatgcatttgtcgtacagatatgtagatcattatcctgcatgttatatttgaataaaatttcaatcaggcagcaatttatcgatttattggtggttagaaaaaatgagaaggtcagtgaataatataatctgcaaacgagaatttgtaactcgcgcaatgatcaccataatctgtcggccatagggtatctctattctatcggttatttagtggtacatattgcctttgccaccatgtttggatatgcaggcccggagcagatgaagatggattgaatcagataaaatacttcagtatcttcaaaagtaccaccatatcagattcagataggatctctcataccaggatgagtccgggatttgttcccgtaatgcaccgccccctcccttttgaaaccacaaaggtgttctcaattcctaccattccaactcctgggattcctttctttggctcaagggcaaataccatattctcttccagtggctcatgaaaaccctcagcaatcaccgggatctcatcaattaacagaccgacaccgtggccaaggaactttaccttccggtctttatatcccatgaaattctctaaaaattcaggctctaacgttgcgattacatcctggtatatctgcgatgggatattacccgggacaaggagagaagccagatggttctgcacatccacacaccggttgtgcttctcaataacgtcatcaggaagtgatgcaccaaacatataggtcatggttttgtctgtatgatacccgccaaatccacatccaacgtcaacaaagacgaggtctccttttttcagtctcctcttccggtcaccaaggaggggaacggcagggcataatcctacagatccaccaggcccgtcaaaatatgtcggatagagtgagttttctccaaatcctatctgaccaagaagcatttcggtgttaaacataccaaaccgtgcaatcccatgatggccttcattaaccagatgcccatacagtttggtggcgaattcgctctcacgcataccttcagtcagcatatcaggaacgctttcttccagcacccgggcatgaattctccctgactcttccatgagggagatttcaaatgggctcttcacagccctgaccattgagagttcacgatccactgattcaacgtgcgatattggaaaatactttgaaaaccgctggtaaagagcgagcggaacgatatcagtttcaagatgtactgtgtcaggaacgtccgtatatgccctggcagcgtcacgaaaacttcccattctttcaatatacgggaattcagattcatgtttcgcacgttcataactcttcctgacccagagggttggttctccgtcccgtggaatgcaaagcatgctgtcctgcatggtaccggtaaaataataaaggttgatatttccaaaaattactaccagttcatagtcaggtttttgatcctccattcgggctttaaatcgtttcatccgttgttctaactctgatccaggtacccggctgtccatagtacacatttggcgacaaccatgataggatctgtcatggtgcaggtgaaatgttctccataccctcttcctttattacattgctcatacatgatcttacatggtttctctcttttcggtcagttcaatcaataaaaaaatactttatgcaggttctctctctcttcttgttgttgccagtgttattattctgtttgcagcattttctacatataacacctctgtatcaggagctgaagatgaacttaaaattctcgcagatgcacaggctgaagcaataaaaggagtattacttgaaccgatgcactcgaccgaatctttggctgaagtgcttcttgggccatatagtgctggaaaaccactgccaagagaggaagttgagtcaatcatcggtggaatattgaagaaccatcctctctataatggggtttacacgatgtgggaagagaatgcgtatgatcgtgctgactcccggtatgcaggtaagaacgggttctccagtacagggcggatgaatatgtactggtaccgggaggatggtgttgagcagcggatgatatatgagccggattctgtagacacagagactgattatacacaggattactataccattcctgcacaaacacaccagaaactcctaaccaatccgtatgttgaaccatcacagagtgtcccggtcctgatggcgtcaaccatcgttccaatcctctctcagggaacttttcttgggataactggtgtcgacgtcacccttgctgatattgaccggattgcagatgaaacccgtctctacaatggtgaaggtattgtccttattgtgagtaatgacggaacgatagcaggagtaaccggggatatcggaacggttggtgaacctcttacttccctcgcccccgttttttcagtatcagaggagaccattcagcacattatcaccggagagtctgatgcaacctttacacttggtccctatgtcgggaagatgtcagatgtcgtggttggtgatcctggcctgccatggaaggttctggtcctggtcccgtcatccatcctgactgccaatgcaatctcccttaccattatcctggtcatctttggtatcctgatctccgccggtggagtagggctgctttatattgttgcacgatccatcagtcgtccgatacaggagatcacatatgcagccgggcgcctggcagagggtgatctttcctgccggattaatcctgacggacatgatgaggttgctatccttgggagaacctttgataccatggcttcccgcctgcagcagacaatgaatactatcacccgggatggagaagatcaaaaggcggtccttgcagagataaacgggatagcacaggcggcatcaaatggtgatctcaatgttcgtggagatccagctcatttctccggtgagtaccgccatgtcatcgaagcggtgaatgatactcttgatgctgtcgtccggccggttactgaagcaatgacgcttgcccgtgagtattcagcagggaatttctctgcacggtttgaccctggtgttccggtatcaggagactttattcatttcaggacggcgcttgataccattggtatccagatggggtcccttattggtgctctttctaacgaggttcaaggcctgatgaccgagatggaagagtccaatgctagtgtagaggagattgcgtctgcatcccaggcgattgcacgggggacaaatgagctcagtatacaggctgatctgtcaaaatccgaaatcacaaagattcaggatacggtcagttctgtgatatccatcggttctgatatagccaatcagaccgcagaggcatcagttcttatcaatcagtcacagcagctctcacataagggatctgaaagcagtactcttgcagatatcggtatgaagtccattgtaaagtcgcatgatgagaccggcagaatcattcatgagattaattcggagatggataagatcggtgatattgttggtatcattactgatattgctgatcagacaaatctccttgcactcaatgccgcaatcgaagccgcccgtgcaggtgatgcagggaaagggtttgcagtagttgccggagaagtgaaggcacttgcacttgaatcacagaaatctgcagagaagatcagtggtatcatctctcttctccaggaacggtcggcaaagatgaaaagtgccattgatacctcacgacaggatgttaataatggcagcagggcagtcgatgaaacattgaagatcttttctgagctggcatcttcaatcgatgaaattaccaagcggatcgtttctatcgactcagccagccaggatcagatggcagcatatgagatggtgatggagcatattacttctatgaatgagtcattccacactatcatcaatgagctgggcaatactgctgcattaaccgaagagaactccgtttcacttgattgtattgcccagtctattcaggaagcaacgatcaggatagataaaatatcacgtgatatgtcccgtttcagggtatagggtaagccatgccatataggtctgtagggacaattcattccttttatttccctgggataaggatatttcagttatgacaatcagggatttcatcatccggacctgcacagatatgggcatctcatgtgtcggatgtgccgctgtgatccggtgggagcagcccctctttttcccgtgggttcctgaatcatgttatccgaatgccatctatccggaggcacaaaccgctgttgttatcggccttcccgtgcatctgcctgtggttgagactgctccatccatctggtatcgtgaagagtataagatcgtaaacagtctccttgatcaatatacctggcggatagcgactgttctgaatgatcagggttatgcatcggtctcaatcccccgtgacgggtatggcagtatcacggtacttcagaagaatccggctgcgttcttttcacatcgtcatgctgctgtgcttgcaggtctcggcacctttgggagaaataatatggttctgactagagcatgggggccacgggtcaggtttggaacggttctcaccagtgcccggattgaatcagatgctcttattgaatcatccctctgtacccgatgcaatgcctgtgtccgtgcctgtccggtccatgccctggaagaggaggattacccagaatctaaaacaaataaaaaggcgtgtgctgaccggagtgctgccctgaatggagagtaccggtctccatgtggaatatgtatcaaggtatgcccggttggagctgaccgggatttgtttaatcggactgatatcaggatgtatgatgatacaggtgcatggaaaaaatatcatgatgcctgggaccatgtccggtcttttggtagtgattgatcaatgataggatgaatcctgatactgattttcgtgagagcgggcatgtgaaattttttcaggcaggaaagcacttgtgacatctcacttcatcccatttttgaacaataccagcaatatgatgtttttctctcaaaatccgaaggtaatttttctgtatgatgacaaaccttatatgctcatgcggcaatctgtatgtgcagacgaaagagtaaattctggaaatagtttttgtaagttctcgttcagttcgaaagggtatctcactgctattcttggtaattctctggcgcaatgtgattttgatcactgcggcccaacagttatgcaaaagcccataagggactatcatggaaggaaagaaattatacgtaggcaacctgccctactccacaaacgaaagccagctcagcgaacttttctcatcctatggagaggttgtcagcgccaaaatcattgagaacaaaggttttggatttgtcgagatgggaacttcagaggaagcccaggcagcactcgatgccctgaacgatactgaatttgacggaagaactatgcgtatcgatgaagcacgcccaatgcagccacgccgtgactttggtggaaaccggagcggtgggtttggcggctcaagtggcggctttaacagaagacgcttctaatcagatcaatatctcccttttttatccaaatattggattattattcaattaatctgttaatatcctgttgcatagtagtatccgtcatcatgaatgatcctgaccggaacatcaaagacagcacggataaaccgatctgtcagtacctcttctttcggtccgtcctggtagatggcaccgtttttaaacaaaatgacccggtttatctccgggatgatgtcaggaagggaatgagtgacaagtatgatgacagtctgtgccgcaacttttctcatggtagagcggagcatgtgcagggcatgaaggtccagactgtttgaaggttcgtcaaggatgaggacccgtggattatgaaccagtgcccgtccgataagaaatctcctggcctcgccggttgacatatcagaaaatgatcgatcagccagatgggaaatttccaaaaaagagaggatctcatctgccttgttttccatctctggtgtgatggtatgaaagaagagcccgatactgctaaaaaagcctgatagaatcacctctctcccggaaatattccggtgaaatgtatattggaggtcctgggatacatacccgaaatgggatcgaagagtaaagacgtcccatgtctcctgaccccagatccgaaatactgagcctgattctgaatagactggataatgctccctgatgagtgtcctgataaaggtggattttcctgagccgtttggtccgagaatagcaacgtgttctccgtcaggaatctgaaccgagagtgcatgtaacaggatcgtcgtattgtgtgcaaccgtgatattttgaaaatctacaaaaagtggtgtatgattcatgattttattcccgagttttcattctccatgattcaggtggaatacttatctcaaaccgtgctccctttccaaattcaccattttcacagatctgaatattcgtaaccagcaggatctcccgtgcaagtgtcagaccaaggccggtattctttccatatccctgcttaaagatgcgctctttctcatccggtctgataccaggaccatcatcttcaatgacaagtgcatatgatccatcatccatcttctgcgaataaatctctatccgggaaattcccgtggcatgacgcatggcattttctaagagattgtatatgacttttaccgagagtggatcagcaaaaatgtccgctggaacgaggtcaattgtcagttcaacctggtcatgctgaatatcctctacagcccgcagaatcagccgttcacaatcctgccatacgggctcatgaagtccgatactctggtattcccgtgaaaaatgcagatgtctggtaattttttccacgaggttgatacagacagagagtatctccttgcgcctttgttcatcatcctcactctccaaaatctccagataccctgaaacggccataacaagattgctgatatcatgtctggtcaggtgtgtcagaagggatatcttttcatttgcaagtgtgagtgctttttctgcattcttccgttcggtgatgttatgaatgataagaattagtccggctggtccccggtccggatcagtgaccagtgatcctgatatgctcatggttttcttagtgtcagaatccggaattagttcatagtcagagatcattccattccggacaatatcatcgcgaattttggaaaaaaccggttcaggcagaggaggtccggtgaatacttccggatttgtctgaaatgaaccggtgagaagtttttttgcagaattgttggtggtaattacccgcccatccatgtcggtgaggagaagtccgtccggcatggtctgaatgatatttgttgcaacagtttcaggggttaaaatgaacagtccgtatttcaggattgcataggtgattgccaccgaaaagagaacaatgccgataaacaccatattaggtgcaaaaattccaaaaagtggcagaatgacgacagactgcgaaccgaatcctaatagaataagaagtccgatactgacagaacttgactgccgctttaaggtatcattcccggctgatcttcgtgcctgccatccgatgtatatcgcccagaagagaactgcaaggaaatagattgtagcagcggtataaattggatccccgattgagggtgtgtaataatacctgaaatctggtgagtatccgacggtaaagatatggtccgtgaaaaaattcacccctgcaagaattattgcgggaatatagaggagcatgaggagatatgcacgattttcccgtcgtgccatcggatgatccgcaaaacagaggatgaaatgaatacacattacgatgaccacggtccatagggaactcgccttcagccagaacaggacattttcataactattaacactccaaatcaggtattctccgacagcccagtatgatgcaccggcggtcaccatgagaaacaggcggttcactctggaatcagggtttttggcatagacaaaaataccaagaccatacgtgattactgctgaaataagacagaataatccaagtatggcgataccgtccatgtgaatccccccataattcaccagttagaagaacatccggttatgcccaaccccaccaggcaaaaaacagatgatgattatctaaatcaatacatctccctatcagctcataacccttttcatacgaaaagaactatacagctcccgatcgtctctatactatggtctctcttgaaaatcttcctcagaccgatcggattatcttcctgaccgcctgctgttttatcatcctcgcagggttgaaaatggccggaggttttataggaccgtttttattatcggtatttgctgcggttatcttctccgttgtctcgctatggttccaaaaacggggattcgatccacggatatccggatatctggcatttttcatctttctcggttgtcttatcggggttgtagcgatggtggtgctttcgatatcacctctcattgaacatataccccggatagaagaagggatacagtccaatatgggggagattgatacaatcctttcaaaatttggaataaaggtgtctactctcattccggcaagtcagatgaccggatcacttggtgtcatctcacctgaaatggttacctcttttatcgggcagttatccgctctttttatcgttctctttacaactttgttcctgcttttagaggctacggtattctctcagaagatcaataccgtccttggttcgtaccggcaggaacttgccacccggatgactgaatttggttctgtcgttattgaatatgtcataatccggacaaaagtgaattttgttaccggtgcgggatttggtattgccttgtttatcatcggggtgcaggacccctggctctggggattattgatgtttgtgctgaactttgtcccttatatcgggtttattatcgcccttgttcctccgacggtgctggctcttatagaaattaacccatatgcagcgcttttggttgtaattgttgcaagtattgtaaatctcttctctgaaaatgttctctttcctgaactggcaggcaggggtatggagctctctccagcgattgtattcatctcaatgatattctggggatattttcttggaggtgcaggggttgtcgtggcagttcccctgacagtacttctgaagatgatccttgagagttatccggaaacccgatcccttgcgatgattatcgggtcggttcaggaagagccggatgtggaacagatctgatcataccggatagtcatttcctgtgccaacttttttttatctgcttaaaaaacctgtatgcatgagtaatgatatttcctgggattctgccagaatggagtttaagccggtgactatgaccgtcaggcatactggtaacatgagtttttccgcccataccagcaccggacttaccattccgatagatgcccatgtccatcttggcggcggaggtgccatcccgaatcctatcgattacctgtttgcatccctgggcgggtgcattgggattaagattcttctggaccttggcgataagggaataaaacctgaacagctcctgatcgaaacaactgcaacacgaaaacaggatctcccagctaccttcgagacggtacatcatctcatctccctgaaatgtgcttgtgatgaggctgtcatagcagataccctgaaaaaaaccatgactctcctctgccccattgcggtcatctttggagagacatcaacgatgacctgggaattcaggttaattcaataaaaaagggatagttatttcccggactcatccggctgttttttggaacaaatacaatggtgataagatcagagctgaatgccgatggaacagtacctgtcttcgcatagatatgcaatggagtattaagcacttcctgaagggcggatgcaataattgtaagaatcacgatcaggaggatatactcagtaatcgcggccaggatgagcgccccgttcccactcagggagacaaggaagaccggggctagtgcaataatcccaatgatcacaaagatgagtgagatagacccgggacctacgattgcctcgcaggttcttcgaaagagtgctgctgactcttttatcgatgccccaattcccagatcccttaaaatcatgactgatttaacgaagtatgtcagcagactccatacaaagccgatcatacttataataatctgtctgataatgttgttattatccccaatcagagagagaatcaaatcaatcgtagcagttatgactgttcagagaaaaagaatgcatgcaactccgggaaggaccgggaagaggagtatctccttatctttctgaataactgcaaaactttcccttgtcagtgttatgctgcgggataatgattcaaacatagtattccatctagttattacttgctcaaaatttcgtttatgcctgtttttgatgcaataaattacgaacccgctcgatatcctgaaatttcatctcatatgaaccgattaaggtatccctgagttcatcaagcatctcattaagggtcttggcgatgtgaaacaccttcatcggtctccctttattctctgttatctggtgaacgatgtggatccatctctttttcataagatcagttattgcactactacttccggctgacgaagttccaccaccctctcaatctcacgggaggtcagatccacatcttttaccatgagtgtcagcacacgggcactgttccgcctcagcccgatatcccataataaatctgcaatcttctcatccccggcggagaagtgcagaccatattcgctccccataaaacacacacaaaaaacttcatagatcttgcccgggaataccaggagatcggcgttagaaagccggtatggaaaccagtattacagacgttccttgatgtgacggcaacgatgaactgtaccgtggcatttggggaaggcaccaataattgcagttcagttctggtgtatgctgatccacttcttgaaaaggtgttttttaatattgttgataattctattaaatattgtccagataagccatgtattcgtatgcaatgtcatgaatccgatgaaggtcttattatttcgatatatgataatggcccaggtattccagatactgagaaagaacagatctttaccaaggggtatggaaaagggaccggattaggattatttctagtcagggaaattttgagtattaccggaatgaaaatccgggagaccgggaaattaggagagggagcaaaatttgagataatcgtcccccccgggaaatatatacgtaccgggtaaccagagatctgccagaaactcctgacctgatattttcttcgtcactattattctaggaaacagagaagatcccgtaaataggatgtaagagagccgggtttatccgctttcagcacaatatatcataagagagggagagataaaaccgaggagcactagtatctacacattccaggatctgattgagggtggatttttgtatgtcgataaaacgcgagatgtgtatgaactcgtccggtatccaaaaggcctgttcttccttgcaagaccccgaagatttggaaaatcactccttctatcaacaataaaattatattttctcgggaaacgggatctcttctaggggcttgtcccagactctaaatatgcctgatcctcaggaatattaagggccttgagggatttccccaatagggtttttcatgtaaaataagcatcttgaagaaattagatcacgtgtcctacgtgaggttaatttttaatggtaattctcaatccctcctttcttattgattttatccagaaagatagagatacaatatcacttctcagggaactcgaaagagataatgagattatctgtataaccattaattactaaactggaacttttcaagggagtattctgattatcagatattgagagagataaaagggaggttgaagaattaatctcggtcttaatttaattagatattgattcaacggtactcgagagacatgagaactatcatcaaatcttaaaaaagggtgattgtattggagattttgatgaattgattgcatcaatctgtcttaccaataattattgtatcatcactcgtgatttacattttcggaaggttcccggattgcatgttcgttcttactaatcatacataaaattaattttcttgcatcatgggcctataccaatttgttgtactatggaaattgaaactggttgtcgtcaattgagtcataaattttatatagatcccagataacttatttttggggtagtgttatgacagatctgccaattgcagcagttgtcaggattgcgaaatcgaatggggctgagcgtgtcggcagcgatgcagcggcggtattagttgagaaagcggagaattatatcggataccttgcaaaggaagcaaataagcttgccatgcacgcaggtaggaaaacgataaaagaagaagacgttgaaatggctgcaaataaggcctgaatggcttcttcttgttatttttctcgtgtttgttatcatcctggtgtgcgcaaattattggtttctctctggaaagtgggaataattgtgtatacctgttcgtcaattacctgattttcaggtatgaatttgggtattggtgtacatctgactgggtcacgggatagattctaatatctggtattccaatgtaataaggcgcgagggtaccaaagcctggccaaatgggccggacttaagatccggtttcgaaggaatccaagggttcaaatcccttccctcgcatataaatttcattttgatcttccattcagtgtatttttctcttgtgttaaggccattgacatgaggttttttatgagtgtcagatgggttctttatttactttatttttgcttaatagcgcattaattcagtctttctaattcgtcattaaccatagaatatgataaagagggaatttctgactgatattgtttatcaggaaattttcggtactggcctcctttagaactgaacatggtagtttaaaaactcactccaattccaaagatgatcagtaatactttctaacattgctggagacttgtgactactttttacttcgataaaattatgcacaaattgaaagatatttagcgctgaaatgaatctattgagtttttttgaaaaagaggcagttttccttccaaaacggctcaatcgttgtctgattttattattgtagccctcaatgactgaggtagagattgctttactatctggatttcccataattttctctcgaatgacataaacaagtttattcttctcttttactttgatcacctgaccataatccaagcatggctcacaatataattcaggtaaacaaatgctatattggacgtttccatcagtaaaaatcgatattttgttttctggcgttggaagttccattcggttaaaaaatcgaactaacatatctgcacaagtatcaatatttctttttccagattcaaatgctaaaaataatccagaatcccttttaaaacaagtataggaccaacaatcacctaattcttcagagtcagttgttaggagattcttgtttttttttgaacaaactcccaaatttcatccatctcacaatcccccgcggaaatgtcatgaataaaataatcgttgagtttttcagcatgttcaccgattaagtgataatatcgagatatagtgtcgcgatggtgtccggtaactcgagatactcctcgaattgaagttttttcagtcgagtgtttcgcaattatgagaacagcagttcgtggtaaacgagaatcatacagaggagtatttttagtttcaataaaaaaacgtcgacagtgatggcaatagtactgttgattgcctgcagaattatgcccatttttagtaatattctttccatcttcaatttgaaaataagtacaatccggattttgacacgtaatcaatataggaccacgttttccaaccatgaaaataattatatctaaacttatattaatttttagtacataaaatttaatactttatttgcacttagtattaccagcttgctaacagggcactaccaaattttctcacctgtataaggttgatgaaagtatgttgaatcataagtagtcactttactctcaatgaataagagtgtaaaaaaggtgatttggatgaaaatggtaataattattttataacaaaatcaaggcaaattattattttatagcgataagctggtcctgaacggtaaattgtttcttctctacatatttatccggttccatgttaacaacataagatgttacatcaaaaaccccatttgagaaaccggtaatactaaaggtggattctgcgagcggttcagcgacaacatttgtccctctaattgtaaaggtaactgggatctgagttttcgctgcagttccattaatttcgatatcataatttccttcaggcatagtaggtttatcgatctcatagtcatacaatcctgtcgcatctgcagtatctaatgctccattatatttatgttgattaactgaaacattcaacatactattagggactaatccattcatatttatccgaagtgttggattcgtgatatctaatggcaaactaaggttattcaatttgaaagaaaagaatgagccagcttcagttttaatattgccgataatatcaattttaaaaggatctcctgctttaatgttaccaataaaaattgaaacctcttcacctggtttcacgacatcaggacttgataccatcacggcagataccgttccgaaatagagtattcccaaacatataatggagaggactccgattgaccatttcaaaccagccagaattgacatcataccatcttttaccttttatacattattaagatatggatgatataaggtggttctggtacacatcacattgaagaattttccgacggtaactatccccatctgtgattaaataattcaatgaaggttgggagttatggatctgattttggaaaaataaaagacttgtcagcatcggcagaactgtctgtgtatcagtatattcatgcaattaaatcaattcgcccgaaattaaataatctatagagagaacattcattttaagatgcttgttctgcatgagtaggcttccgggaaacctgtcagatgatatcatccaggctagagaagaacgggtatgaatctgtttttgatccctctgccctcgtaaagatcttccataatgagaaagggtcagagagaactcgtgaattaattttaaatgcacaaaataatctctatatactggatattgcgcaaattgaatattatagtgcaatatttcgacgatatcgtaatcatgagttgtcaaaaaaatcattgaatatcgctatatctggatttgaaaaagaaatatctcattattatattgagccgacaacaccgctggtgattaaagaagcccaaaacctcatattttcatatggagaaaaatctgaccttcgaacccttgattcaattcatctggcagcattttcattaatttcaagtgaagattggatctttgtttgttgtgactctatactgtcatgtgttgcagaagaaagtcaatttaccgttttaaatccaatacaacaagaaaatataggttttaaccatgagtgaatatccatttaccgtaccgtttatctgaataatccagaaaagtattccaaatcaattcatgaagatcatatcaatcgtcggtgccaggccagagtttattaaatgtgccccggtatccagggagcttcgaaaaaaccaccgggaggtattagtccataccggacagcattatgacccggagatgtctgacatcctcttcgaggaacttgagataccaaaacctgattaccacctctgggttggttcaggaccacatgggaagcagaccggtgaatgcctcgcgaagatcgaagaagtcctgatcaaggagcagccggttcttgtcctagtgtatggtgataccaactcgactctggccggagggctggctgtagtaaaattcaacattccggttgtccatctggagactgacttctgatttttgacaggactactggaagaggaggtatatttggtgagcactactcttatgataccatcttacaatacataagataataaattatttagaaccggtgagtttgtgaaaacaataattattccaatcccaataacatatctgcctgagggctattaccttgtaacgagtgatgtactccctggattaattgcacaaggtaataatattgatgaaactattgagatagctgaagatgtggcacgaaacctgatttccattgaattagaagagaacagaagagaggccctcgaaacagatccggaatcaacgtatcttttagatattcatgtcccaattcctgtatctgtatgacacgaataccacggtatcaatcaaaagaggtggtccgtaaggtgatgaaagtgggatatatcttaaaacgacatggaaaagggtctcatgatatttattatactcctaaccgggctcgctctagacccctagaggagagatatgaaaattgatttttcatgtataatttagatgaaagtagaatcacaaaataaaaccaatgggtatcgcaatgatcccaatgataaaaacctgtacatcgtatcatgaaaaaaagatatctgttcagattggaatagagtattatggtgaaagcggaagtttcacaaaataattagatatgtgataaaataaccggattttcagatggaacagaagtcgaagtctcaagaaacccacataaaccaattcgggatttgttccatggctgccttcaaattgatgatattcaggttatcgaggagattgctgaatcggatgaattgtcatattattggtgatattccggataatttcatgttattgatatgtctgatttttccctgaaattcacttccttttcagggaaaaggagacgagtattactaaagttttttgaaaaaaggttaaaggtgcaggttacgacagatcctaattggatacaaagtaaaaaatactatgcatttctaaatcttaatttaaacatgactattatttctgaacaacagacagatttcaatctcattaatttgaatcgtcttgctcatataatcaaatcacttgatgaaaaggagattgagactttggaaattctccttgataatgattcatttgagatcatccagcagtcttcaaaggaatattctcaacaaaaaggaattcctattgatcagtggtgaaatggagccctatggtatctcgatggctccttcggcattgaaaaattataagaaatttccagaaaagttaagggaaaagattaaatcggaagctcttcacattgctcgtaatccatatatctatgaggaactgtctgaacctctcaaaggtatcagatcataccatttcacatttaattcaacacaatatcggatagcatatcagattaatgagtcttcaagggagattgagattctactggtaaaaaccagagaaaatttttatgacaaactatttcgaacattcagataaaaataaaaaaccactcaccccatttaccatctgcgttgtcggtcttggctatatcggaactcccctggcttgagcctttgcagagcaccttccgaccatgggctttgacatcgaccggaggaagactgagctgctcacggcatcaggctcgaataatctggccacgactgatccgaaggcaatccgggaggcggatatcatcatgatctgtgtcccgacgtcggtgatgaaagcgaaagatccggatcttggcccggtcatgggtgctgcacgaacggtggggcagaacctgaaagagggagcaatcgttgttatggagtccacggtctatcctggtgtgactgaagaggtcgtcgtgccaatccttgagcaggagttcgggaagaaatgcggagaggatttctttgtcgggtactccccggagcggatcaacccgaatgacgatgagcatactctggagcgaacgacaaagatcgtatccggcatggatgaaaagactacagataagaactgccaggtatacggattggtgacgacagtgtaccgtgctcctgttatccggaccgctgaagcggccaagttcatcgagaatatccagcgtgacctgaacattgttcttgtcaacgagttatccctgatattctcccgcatgggtcttgatacgacggcggtcctagaggctgccgggacaaaatggaactttcacccgtaccggccgggacttttcggcgggcattgtatcgcggttgttctctgttcatgattattgtaagaaagttgaaagatacaagaaattaaatcactcatctggaaattacctttattttatacgtttacacatatgatatgtaatccattgtgtgaataggtgtgtggatggcaacaaaccttgcagtcgacgataatctcatctccgaagccctggtaattggtggatgtaacaccaagaaagcagcagttactgaagctctcatagaatacatccaaagaagaaaacagatccagattacatcattgttcggaacaattgattatgattcagattatgattataagaaaaataggtctagaacgtgaaaattcttgtagatacatctgtctggtcattagccctgagaaggtctggtgttagaacgccagaagaagcaaatctcgttcattcattgattgaactaatagatgaaacccgaatactgatgattggaccaatcagacaggaattattatctggaatctcttcaaataaacaattcgaagaattgaaagaaaaactccaggcttttcgagatcttcctcttataagctctgattatgagaaggcagcagagtgctataatatttgtcgttctgcagggatccaggggtcacacatcgattttctcatctgtgcactagcagaaagagagaatgcacccatttttacgacagataatgacttctttcattatgcaaaacatcttgatatcactcttttttcaccaaaaaaaataaattcgcagtttaacatccaaaaaagagttactttttccatgaaaatcatatcaatcgtcggtgccaggccagagtttattaaatgtgccccggtatccagggagcttcgaaaaaaccaccgggaggtattagtccataccggacagcattatgacccggagatgtctgacatcttcttcgaggaacttgagataccaaaaccagattaccatctcggggttggttcatgaccacatgggaagcagaccggtgaatgcctcgcgaagatcgaagaagtcctgatcaaggagcagccggttcttgtcctagtgtatggtgataccaactcgactctggccggtcgattaatgactcgatggcgggtcatgtggcacggatggctatcatgggcctgaatgatgtcggaaaggtgatccgggggtcgaatgtcctgattatggggcatctacaaggaggatgtgcctaacattcgggagtcgccggtctttgagatcgtcagggagggaattgatagtgtatacgattgaagagtatgggtataaccctctgctttccgatgagatgattgagcagttcggggtgaaagggttacccgggctggacctgaagatggatgcggtgataatggcggtgggtcaccgacaattccgggagatggggtcagtgagattcgtggtctgatgaatgaccatccggtgcttgtggatataatggattgtgggccagggagaagcggaagggagagggatttggtatgggaaattttgaattaatctgcataaaccaaaaatatctcaactcaaatatggagggaaaacaaagattatagatattttgttatttgctcaatgctcaaatctgcttctttcatgatctgatgaatgatacccgggcgtaattccctatgctgggggataacaattctgaagattgaaccctgttttttcatgatgcaatgactaccggtttgtcttaccggggtccatccaaatcgggttagaatttttaccatttcgaatccagaaatcactggtagacgtgtcatatagatacttctacaatttgagattggctattggtgggtgatatggttgattcctcagataatacatccatatataactgaattgcatctttgacattttcaattacttcatcaaatgagtcaccctgcgtatgacatccaggtagagcagggacatgagcgatatagcccccatcaggctcttggattaattcaactttaaattttaaagtcatattattacgtgttaggcatgaatttatatcaaatttatctcatttttcatcaatgatatggatggtctgcggaaaggatttctttgtcgggtactccccggagcggatcaacccgaatgacgatgagcatactctggagcgaacgacaaagatcgtatccggcatggatgaaaagactacagatacgaactgccaggtatacggattggtgacgacagtgtaccgtgctcctgatatcaggaccgctgaagcggccaaggtcatcgagaatatccagcgtgacctgaacattgctcttgtcaacgagttatccctgatattctcccgcatgggtcttgatacgacggcggtcctagaggctgccgggacaaaatggaacgttcacccgtaccggcccggacttgtaggcgggcattgtatcgcggttgttctctgttcatgattattgtaagaaagttgaaagatacaagaaattaaatcactcatctggaaattacctttattttatacgtttacacatatgatatgtaatccattgtgtgaaaaggtgtgcggatggcaacaaaccttgcagtcgacgataatctcatctccgaagccctggtaattggtggatgtaacaccaagaaagcagcagagttctataacatttgtccatctgcaggaacccttggttcaaccatcgattttctcatctgtgcattagcagaaagagagaatgaaataaatattacccccagatagtgacagatttacctataagaatcatattatctgtgaataagataattaaaataaattatcaagagggagccatcatgaaggttaaggatctggttttggatgaaattaaagacatgtcagtttcagaatatctgtctgtgtatcagtatattcatgcgattaaagcaattcgcccgaaaccaagtaataaaaaaagggaacatgcatttgaagaagtctgttctgctctgagtagccttacgggaaacctgtcagatgacattatcctggctagagatgaccgagtgtgaatctgtttttgacacctctgccctcgtaaaaatcttccataatgaggaagggtcagagagaactcgtgaattaattttaaatgcacaaaataatctctatatactggatattgcgcaaattgaatactttagtgcaatatttcgacgatatcgtaatcatgagttgtcaaaaaaatcattaaatatagccatatcaggatttgaaaaagaaatgtctcattattgtattgagccaacaacacccctggtgattaaagaagcccaaaaactcatattttcgtatggagataaatttggccttcgaacccttgattcacttcatctggcagcattttcattgatttcaaatgatgattggatttttgtttgttgtgattctatactttcatgtgttgcagaagaatatccatttaccgtaccgttaatctgaataatccagaaaagtattccaaatcaattcatgaagatcatatcaatcgtcggtgccagaccccagttcatcaaatgtgcctcggtatccagggagcttcgaaaaacccaccaggaagttttgatccataccggacagcattacgacccggagatgtctgacgtcttcttcgaggaacttgagatcccaaaacctgattatcatctcggggttggatcaggaccacatgggaagcagaccggggaatgtctcgcgaagatcgaagaggtcctgatcaaggagcagccggatcttgtcctcgtgtatggtgataccaactcgacccttgccggagggctggctgcggcaaaactccatattccggttgcccacgtggaggcagggcttcgaagttttgataggacaatgccggaagagatcaaccgggtcctggtcgatcatctgtctgacctgctcttctgtcccacccagactgcagtggataatcttcgaagcgaagggataacaaagggggtgttcctgaccggcgatgtgatggtagatgctcttgaatataataaggagatcgcaagggaacgatcaaagattctggaaaagtattcgctcactcccggcaagtatctgatcctgactgttcaccgtccgtcaaatactgataaccctgatcacatggaacatattatcggggccattggtgattgtggtttgctgacgttatttcctgttcatccccggaccaggaaaaatcttatctcgtttgagttgtgggatagcatgccggggaatatcataccctgtgttcctcttggataccttgatatgcttgcggcaatgggttcagccgggaagatcctgaccgattcaggcggagttcagaaagaggcgtacctgctctcggtcccgtgtattactttgcgtgagaataccgagtgggtggagacagtagaggcagggtggaatgtattggttggggctgatagggagaagattggagcgatggtaagagagtttctgccttccggtgggcatccggacttgtttgggagtggtgcatcggggagtattggtgaactggtcggggagtatatgaatggggtttgaattccttaaatccgaacgccctgacctgtgggaccggtttacccgacgggaagagtacgaaaatcctatacgagatatgtatgggaggtttccatactgggcaagtagggaacgggatatctttaggccctcagtttcggaatatttgtttgaacaaggattagttaatccggagtatccggatggatgtgagtttgcggtttgggtgacccatgatattgatattatatatggatctccatatacaaaattgatagcaggatgccttgcaataaaacagggtgatacgaaaacagcaaaacaagaaattttatcactccacacgaaaaaaaagccatatttcaattttgatgagattctatcattagaggagaaatatggtgtgaaatctacctggttttttcaggcgctaaatccaggtgagccggaattcaggtattttttatctgatattgagtgtgtatttggggatattcttgaagctggaggagaaataggtcttcatggagggtttgaagccccatataatctggataaactcttacttgagaaaagccggcttgaaaagatactgggtcaaaaagtagcaggctaccggaatcatttcctcaaatttcaaatgccggacacgttggaactgcttgcacaagcaggtttttcttatgattcaacgcttggttatgcagattgtatcgggtttagaactggcatgtgtcatccttacaaaccggtgaatttgaataccggtaaagagatcaatattattgaattaccactccatattatggaagggagtatgttccatcattatatgcgacttaattttgatatgggatggaaactagtccaacagattattgaaagagttcaaggatgtcagggaatattggtaattaattggcataataccagttatcgggaatggagtgttgagagaaaacttcttgagaagatacttggatattgtcaggaaaaggatgcctggatgagaacgaatattgatgctcatcaaaaatgatggattggatgagttttgcaatcaaaaataaagatattagttaccgatgctggctataagcatacactaggaattgtgagaagtttagggcaatctggatattatgttattgcaatggatccgaataaaagatcacaatcatttttttctaaatactgtaaagagaaactcatttcccctgacccaaaaaatgaagctgattttattcattttttgaaaaattatttgatgaataacaaaattgacgtattattacctgttggttataattcaacaataacaatatctaataatagaagtgaattattgccatatgtaaaaatccccatcgcagaaaaaaaggctattgatatcgcatctgataaaagaaaaaccttacaattagcaaaaaatctacaagtattaattccaaaagaatacaattcaattgagaaaattggtagatatcctgttgttttaaaaggaatatatgaatctggacagataaaatatattaattctaaagaagaagcagaaaaaatagatttggcaactaacgtcattcaggaatatatccctggtgaaggatacggattttatgcattatttaatagaggcaatgtgagagccttttgtatgcatcaaagaattcgagaatatccaattactggcggttctagtacttgtgctaaaagtgtttattgtgatgaattgaaaagaattggacttaaaattttaaaagaactccattggcatggggttgccatggttgaatttaagaaaaaaacatgtaatggaaattatgtgctaatggaaattaatccgaaattttggggttcattagatctttctattgcctcaaaagtgaattttccaaaattactagttgagatgtctatcgaaggggatgtcgaacctatcaaccagtatgatattgatattaagtatcagtggccatttcctgatgaaatacttcacttatgtgcaaatccatattcaatacttgagataatttctgatttttttgacaaacgagcatattgcaatataataattagagatcctcttccaaccttaattcaaatgatagatactttttttattttaagttcaaggatattaaatcggaaaataaagtttccacatggaaaaccaacgaaaaattatgattgctgatcttcatattcattcaaaatattcatttgattcatttctttctccaaaaaacattataaaagaagcgaaaaaacataaaatagatgttattgccatcactgatcataatacaattcgtggaggacttgaaactctaagaataaatcttgattcaaaaatctccgtgattgttggaagtgaaatccatacagaaattggtgatattattggattatatttaaacgaagagataaagtctagactatctttagatgtaatcgatgagataaaatctcaaggaggaatagttgtcttaccacatccctttaggggtcataatctgaatgaaaaattaattaatcaatgtgatgcaattgaaatctttaatagtagatcttcagaaattgaaaatcaattatcattagaattggccaaacagtttaataagccttttacagcagggagtgatgctcatcttgcatgtgaaattggattagtaaaggttgttctaaaaatggatgaattaactgagagaatatcattttcatccttaaatgaagatttaattggtacttactcttcgaaatgtctaaaacactgtagtcaattgatcaaatcattaaaaacgaaaaatttaaaaaaaattccttatgatttctttaatgcatcatatagtattatcaatcgcaattaatgaaatttttcttccttgcaagaattcttattacgggcagatctaaccgagtgtacctttttttatagtaatttttgagactcattgttagataattaataataaaaattacatcagatttacatatattttttacattaaactctccctggttaaacattttttttctaccattaaaaaactccatccataatacaatgttttcaattcgtgagtcccagaaatgggagtttccatccttttctaacaataaaacatcataattgtttttctctaataataaacgaagactcgtttctgaaaaagaccaaaaatgttgacccatagaactagagggaaatgtatcaatttttaacacgtatccttcataatcagcatctggaacctctaaaaagagaaaatgatttttaaaattttgttgaaatgttttaattatttcacacggagattgaagatgctctagaacatgtatgagagaaataaaatttatttcagggttttgactaacaatctctagaacaatatcttcacataaaaatcccttttttaagtttacatgtaaaaattcttttccccattgaattgaaacagaatctggatcataccctactcctgagttgataaaacctgatttttgtaaaaacgataaaacccagcctcttcctgctccaaattcaagataattaattgaatcaggtattttcaaattttttttcaatccatcaataataaacaaggattggatttctgccatcttcttctcaatgtcatcagcatgtcgaaaatatcgtgaagaatagtatttagctactgaattcgcattaggtaaaggataccgaaaaaacaatccacaatttttacaatggtaagttgatgattcaactaaatttaaaagttttagtgaattgagggtgttgcaccaatgatcaatatcatgcaggatcacaaatgatcgatctctaccccttaagctatcaaccaaaatagactaattgatgtatgaacctgcatgtatcaattcccactttacatactgtgtttgcaaaaatataggaaaaacctgaacctcttgacggttttataatattcgtagcaaattctttaattttaactataccctcaaatctgataagtttttttatattatgcactaatgcagctaaaaagaattctccctcgcaattctctttccctttttgagagaaactcctaaacctcatattatgtttcatattaccaaaaactggttcgaccatgtattttcgttttcgatataactctctaccagtgggggatttcacacgtacttccataactcgtttacaaatttcctgagttgttgcttgtttctctctgttcataaaagattgccaaacaaacgtcccgatactttgcaattccggaaatgtgattatttctcccatacaaatcgcccgacatatcatttccattcgtgagatatacccatcattatctgaatattctggaatttttctttctttagaaggagggatgatgagttgaatgccataatccaattctgctaaagaattcgggtatgagaaataacctgcatcagatagtagtatattaggcgaaattgatggatgaatacccgtaaaaaggtcttcgagttcatttagcataggtattaataattttttatcgttttgctcatctgatatcattgcagcgaggataaattgattttcagaaacgataatctgcccattatacccttgaatccagccattggtggttgacattatctgactttcaggatcagtgagatttacttttgaatctgaagatggctcttttttaggctctaaaggctttctacctcgtttctttttacccgattctaattcttctttttcgcggtccagaatcttttcttcttgttttttagattcgatatcatgtcgttcaattaatttctctttagcccgattaagaacttcctttcgtttttcttttgttgaaagatgctcaggtagtcggttaatctccatatcctgaatatttatatcatcgttttctaactcatcaatttcctgtgattcatcaaaaagccgacctagctctgcttcaaggtattttaattttttattggctgataaagaggcattacagccaaattttgatccatcgagggctaggacaccgattcttgctatcccggattctacgataatttgagataattgtttaaaaagggatttgatttcttttgaattattcttcttgaaacgatagatcgttgtatggtcaggtgtaagattattggcgacgatccgatatccaatatcataatggcagcacatctcaatttttctgctagatttttctccacgaatcattgaataaattattattccaagcattgaacgaggatcaaaaaaggcagaaccgcgaccatcgtcacgatatttattaataaatggactaatatcgagaatcgaaagaatttctaatatgccataagtaatatcattttcagatagccagtccatcgcattgacagggagtaaaaattgttgttcattaccatatcctctaatcatgttatagcgatgagacatataatatattgatcttaataatatatataattaagctttaataatttatattaagctttttttgtgtttgtgcaacagcctcaattaatatagaaaacttttttagagcatattggacaatgcataatttccacgtattccttattatttcgaactgaaaaggttttttaagattttaaagtaaaatttatgaatatttgttgtaaccatagatattttctccttaaattatatgccgtttttaattctgaatataatcatcaaccttaccttttacattttgggtgaatttctcgattacatataatactataaaaatgagaacaaaatacatcataatcatgattattgaataaataaataatgtcattaatactggacaattaaatacgtaacaaaaataaaaaccaaaataaacccctccagttcgaataatatcccatattaaattccaatgattattaccataaattgaaagaatcgatgttggtgaaactacaaaaccaactatcaccatcgcccccagcgtccaacaataccaaccggcttccttccaaacatgtccaaaaattaccgaaataaaaaccggagcaaacaaggttggaagaccaattagaggcaatcctatgagcgaaaggtgctttagtgttttcaaataaaaattccttaattcttttgaaccatctcttaccatttttgacgcttcaccaagataagcctgacccattgattgcgaaataaaactaccagggagaattaatagcatattagcaagtgaataaaaacccacaatttgagaatcatatagccaaagtaacattagaggtgggagttgaagggatattgtattcataatagatgctggaaaatgaaaaatgggaaaatttttgtaggttttagcaataatcttcaacgaattgattgatatagaattataaatattttgttttttataccaaatactcctcactagagtcccaatcccagcagtttgggagataatatgcccgatgataagacctattggaccgaaagaaaaaagacctagaaatattttacagactgcacctccaataccttggttaatctttgtatatgtaattattcgataatcctggtttcgtatggtataatagttaaaaatactatatagcccaagtccaaagaacccaaaaagaagaaaccaaagatattctgaaatactatataagttaaaggtatcaataaaataatcatcagctattacaagaataaaagcaaaaatggccgttgtacaacacagaagaaccaaacacaaacccaaaagattcgcagcatcttcatcgcgttttggtagccctaaggcaaattcatatcttaatgaagcacctatcccagttattgccaatattgatgaataaactgcaaggattccaaggtcagaaggcgtataaagacgtgttatgattggcatcgaaataatcccaatcaattgggtaactgctgtcccactgccaaggataaacactcctttgtagagaggattgttttgaatgaattctaatatttgaaaagtaaatggtaacttcttaagagatgaaattatgattgaaacaaaccccattatacatttctgcttatgattgactttcattcacgatgatttataatgtcttttgcttatttagcctttgtccaaatctagtttttataatccaatttcaagtttttttgtagatatatgtggtgttgtcaagtgctgaacaataatcaccaaatcttaaagatatttttcctacctccgtaatttctcattatgtaatttcgatatgttatcgaataatcaattttaatgagtataccaattttttagtgaatttgaatcaaaactaatatttaagcagtcaatactaatcattcaattttttcggttaaataattaagtaatacagtaaacttcctcgccatctcgacgtggctgtacttcatgatctccttctcaattccgtgatactggaccgcccccaattccttgtattcccggtatgcctggatcaggtaattgcgaagttcgtcctctgttgcgcagtggactcctgcctttgtctggtccagcagttctttcacaacgcctccgtctgtgtagccgagggagaggattgggcggcgggcggcgaaaaaaataactatgcgctcgaggagggatcttctattaatgattcaaggaatccctttaatttcttcatttttattgaccaatctaaattctcttctgcatatttcctcattttttttgggtgatcagggtctgaacatattttttgtgcaaaatctattaccggatcaatgtcaatcggcgattcatctggggggactctcaagatataaggaaaatcatctggaaaatctggatctttacatgcaataatccacggaattccacgggcacaatattctcggactttgagggttgaagactcagataatccaattctatgaagaccgagacttcccacagcaatatggcaggtgtcgaaaagagagtcaagttcagtacctgatttgaaaccgtgaaagataacctgttttgataagtgtaaattatcaactagttttttgagattgggaatttctttgccattgcccacaatgtgtaggcaaattaaatggttatttttatattcatagattccccggattatgcgatcgattccatgccatcgactgacatttgcaacaaagaggagatatagaatttttcctttttgatcatggtttcgtagaggacataaactaacattaataccattccagtagtcaaaaattagacatattttggtaatttttactaaagatatctcgcataaaaaaacgggttgctcaattacgttaattgaatataagttaagagggtgttgcacaactcagatccccccataatttttcaactaaggtcaatcaaaagtactttaccttagtacgtccaacatatactcaatgtataatacgataggtcgggattttgaacaactttaccttctccccgaggatattagagactgggttccgagtgatgatttctgtcatatattagaggctgttgcataaccaaaatgtcatttccgcaagaggacaatttccattcgattggaacttaaatcgtcgaaaaaaatctgggtttttcctcattgtactaactgtttgaagttatgcaacagcctctaaaaagaaatgaattacagaaaggagtaaattggcaatttacaactgccgatgcacggagtagattgaagcgactttacccacatattaaggtgtcttgaaccactagtacatcgaagtcaggtgtgtgcgctaatctatcaacgatagctacaggcttagaagtgttctctaattttctgcttatttagcatttatgattcaacttttttaaaggttgagaattaagctgaaaaatttgatcaaattgaaaactcccgcaattttcttctttttcattgcaaaaccttcccaaggtcgcggttgaacatgacattttaaagttcgttaatcttataatgattatgactaatattgttttaaaaaaatttttttaaaaagggatataaatgaatattataattttagatatccatccattagaagatggtagaattcagcggcatattaaatatttattagaaaaaaaaattaaagtatatcgaattcactataactatacagataaaactataaagaccggccctttttcgctctttggggaagtgggatatatacggaatatttttttatttggcaataaaaaaatcaacacttttttatttctaatactgtgtcaaacttttcttttttataaagactgtataaaaatattaaaaaaaatatccataaatgagaatgaaaaaataattattcatattcatgatcctcaattactccctttgggtgaatatttaaaaacaaggtattcacgaaatattcagttagtttatgacaggcatgaaatttatgaggtgttaaataattatttagaattaatatttggatttccaaacttttttgaaaagagaattaataaaaaagaaatttcaggtgtcgtcattatttctgatctttattatcaaagtacaaaaaacatatttccatattcaaatattctatcaatttcaaatttcccgtcaattaagaattatgatctagataaaataaaagataaatatgaaaaatttaatgaggattcaataattaacatggtatatatcggtggtttatccaaaaaaattgaccgcgatatcgatcttttattggaggttttttttaagatattagaaacctgtaataatgtgaaggtgatattaggtgggaaggatttagatccatcattattaccaatgattaacgatttatctcaaaaatatccaaaacgatttgaatatctggggtacgttccttattctattactaatgaaataactcaaaaagcgcatattggcttcaattttataaaacctgaatctgaatattgggtgaaaatatcctccaataaaattaatgaatatttgatatgtgggaccattccaatcgtaagggctgatgttgagaattatatggaaatacagaatgtggcaattatttttggaagaaatgaaagtaaagaattgatattgaatacattgttaaaactggtttcaaatcctgaattaatgaaatcttatatgaaagaaggccataaaattgggatgaaaaatacttgggagtctattgctgatagatatcttttattatatgaatatgtaagtaagtaggtatccttgcttcatttatcgggtaagtattctctgatatattttaattaatcttttctccataatgttccaattaaacgttctttcaaatgctcgtttgccatttttgccgagtttttcttgaaaatgtttatcatttttgatttttaatactgcctctcgaattgaggggatatcaccatacggtactaccaatccacagttttcttcactcacgatttttgccatggttgttccactatttactaaaattggtttaccacacatcattgcttcaaataatttattggggctggcatagaaattatttggaacctttggatcgtagaaagcaaaaagtaaatctgcttgaaaactttttaaaatcacggtatcatagttaatttctcctagaaattgaactcgggaatttgttttacaaatatttagtaattcagcaactcgaggaccataaccagcaatttcaaaaaaaatatctgtaatgtcaccacatgctttgattattgatgaaatatctctatccaaagatagtcctcctgcaaaaaaaattttaaaattttctgattggtttgatgtacgtaacttatctgccagttcctttggtggagaattgtatattatagatacatttttataatttccctgttttatttgatgaattctcgatgaatcaacaagaataatttcatcgacatgtttcatgaaatagcaatcgattgattcaactattttccgaattgttggtgaaaatgctatttgatcggaatagaaatcaaaaatatcatatatgatcgggcgagataaaaattttgaaatgattaatgatggaattaagcaatctaaatctgcagcatgaactacatcccatttttcttttaggagccatattgaaacatatatccaccataagggaaggaaaaaaaatattttgtaccccagtggcgcatgtaactgaaatctatgaatataataatttcttctgatttcttgagcttttaccttactaccatatctaccccaccctagaataactacctcattgcctgcattagatagtgttgtcgcttctttttctaaccttacatctggattaatgggatgagatcgtaccattattattttcatgagaagataaatccggatttcatttgtttgataaatatcctagggaataacaaatcagattatattatttattacgtataataatatgtaataatattgttacaatataatttatcaaatatatttaacttatttgattctcccggaagtattttaataaaattatattgtcccatatgttccccaaattgatgaaggaaaccagtttttatattgagtttattataatctaatagagaccttgaagggatatcattaatatttatttggccagaatttaacaatggcaagttggagatttggttattatcttttgtggtataaattgatttccactccttgaaaactatttcttgctctgtatcatataatttataatatgataaatgttcatcgacaaaaggactagtttcaaagcccgcgatagttgatgaaagtgaaaaggaagataataggataaggattacagttgcggtaacaatttttcctttatcggtttttatccttccaagaaaaaatagcaatccttctgctgctaaaaaaattagtgaaaaaatttgcaataatggatatagtctatcaggtaggagagctacctgtttaaagccgattccgaggacaagaaaaatggataagactaaagaaatagatattatgaaaaggtctggtattgttcttcgtcgcaaaaaaattaaaaatccagatacggccaaacctagtaaaatcgaagatccaatcgtattgataaagatagtttttattgggacttgatcatatacagttgactctaccagattcatcgaaatatcctgaaaagatatatagtaattatttattatctggataagacttccaaaaagatttgaataatacatcaattgtaaggagagtatcaataaaaagatcaaaaaaataggccataaaattgccttctgtttggataatttttttttcacataaatttccaaaaatgctaatatgcctaataaaattaaaataatcattgcagaaaaatgatgggtaaatatgatcaatatcgttaatattataatgcagggtatatatcgcaaatttgtggacgaaaaatataacaaaattattgataataacatcaccgaaaaagaataattgtatgcttgatgctctggatgtgctccatacatcaaataataatcaagacagttaaataaaattaccgttattagcgcataattattgttccaaaatgcccttgcgattaaaaaaataaatattactgtggaacaaagtaaaaaaccacccagaattatgtatgtactttttgggtctgaaccgcagaccaatatattaattgcagcgaaaatgtgatggcaagggaaaaaatcgtatgtacctgtaaatatgattgggtgagggatataaccattttttaggattggaatgacaaatgcactaaaatgtaaatcaaaatcaggtaaagcaattcctttgggaaaaatgatttgattacttaatgaaatattcaaagataaaaaaaaagattttaagactaaaaaaatcccttttacatgggtattaataattagcgcttcgattatgaggattgctgtgcatattgatattagaacataatagagtggatttttggtagtgccctgttagcaagctggtaatactaagtgcaaataaagtattaaattttatgtactaaaaattaatataagtttagatataattattttcatggttggaaaacgtggtcctatattgattacgtgtcaaaatccggattgtacttattttcaaattgaagatggaaagaatattactaaaaatgggcataattctgcaggcaatcaacagtactattgccatcactgtcgacgtttttttattgaaactaaaaatactcctctgtatgattctcgtttaccacgaactgctgttctcataattgcgaaacactcgactgaaaaaacttcaattcgaggagtatctcgagttaccggacaccatcgcgacactatatctcgatattatcacttaatcggtgaacatgctgaaaaactcaacgattattttattcatgacatttccgcgggggattgtgagatggatgaaatttgggagtttgttcaaaaaaaaacaagaatctcctaacaactgactctgaagaattaggtgattgttggtcctatacttgttttaaaagggattctggattatttttagcatttgaatctggaaaaagaaatattgatacttgtgcagatatgttagttcgattttttaaccgaatggaacttccaacgccagaaaacaaaatatcgatttttactgatggaaacgtccaatatagcatttgtttacctgaattatattgtgagccatgcttggattatggtcaggtgatcaaagtaaaagagaagaataaacttgtttatgtcattcgagagaaaattatgggaaatccagatagtaaagcaatctctacctcagtcattgagggctacaataataaaatcagacaacgattgagccgttttggaaggaaaactgcctctttttcaaaaaaactcaatagattcatttcagcgctaaatatctttcaatttgtgcataattttatcgaagtaaaaagtagtcacaagtctccagcaatgttagaaagtattactgatcatctttggaattggagtgagtttttaaactaccatgttcagttctaaaggaggccagtaccggatttttttcatagaatccatacattaatgataagaaacttaatccgtagaaaaaagggaaaagaattgatagaataatcagagttttgttccttttcttaaatgataatggaaaagaaaatttttgatatggtgcatttttaaataatattttaataataattaaaagaaaaagaaccccaattattgataagagcattagtaaataactataatatccctttgagtaaaaaaagatgaatatgagtgaaaatgcaaaaaggagaccatactcaatattattaataattactgaaggtttcagaaaatcaattaatggattcataattaaaaaaattggttttattctttatatggacaaactttcatttgttgattcagcgaaaaaatgtcttaattttttcattgattggttctatttccgtatttttgagatttaaaaatattttctcatattcgcaaataatcttatcccatgtgtaatgagaaaggataaattcttttcctttagatgagagttctctagctaattcttcattatccagaatatgtatcaccgcatcagcgattttttgtgaatcacgaggttgaacaagtattgcatgatcagcaaaatgatctctcactccaggaatatctgatgatattactggaagattgaagtacatagcttctaagatggtcgttggaaggccttccgatagggatggaaggataaaaagattggaggactgataaaatgcaattaaatcttttttactgactgatccagtaaacagagtatttttttctatttctaattccttcactaggttgagcgattcgtaataataatctccatttccgataaaaaggaataatacatttttctttgtttttttaataattaagggtattgaataaaggaggtataaaattccctttctatgaataatttgtccaacaaacaaaataataaatttatttgataagttattttttactctaaaggattcaatttcttgattgcttaattgatcagtatttaattcaattggatctattccatttggtattatgtgaattttttccggtttaattcccaaagattcaacatattttttatctgaagaagataatacaataattgcatttgctttggtaaatattatttttccgatgattttactataaattttttctatgaagtcaattataggatttccaaaaaagagttgaccatggcaagttattacaagaggttttctttttgataccgagtgaaaaattgatgttatcgctgcatagctatgttcgttatgtgtgtgaattacatcatatcctttgatttcttgatcggggataaaaaaacttggactgataggatttcttaatggtctgataatacatgaatatctaaaaatatttattccttcatatctctctcttttttttgatttaggaaaattacttacaatcaaatcaatgtcatgtcctttttttatcaaatacttacatagatttttgatataaatttcttggccacctatatatggaataaaatacggggcaatctgtaaaattttcattgataaatccacacccctcccatggatcaaaattattttgccctttttgtaataatatttactatcttctccccggcagttccatccccatatggattactccaccccccggatcctccaatcatcttctgcacacctgccagaatcctttccggttctgtcccgacaatagtatttgccctgacatccactgtctccggtcgttcggtattctcccggagagtaacacagggcactccaagaatacaacactcttcctgcacaccacctgaatcggtgaggacaagtcgggctttggattcaagctggagaaaactgaaaaacccaatagggtcggtcaggaatatcccgtttaccggaatctgaaactgatctatcatctttcgtgtccggggatgaactggaaaaatgatagggatagtatattgtttatgaatcgtcgtcagggcactgataatatgctgcaatttctccgggttatccacgttctcctgccggtgagcggtaacgaggaaatattcctttggcctgacttcaaaggtctttagggcatcacccctctttttcgcgatctccaggttctggtacactgcatcgacgatggtattgccggtgaccaggatcttactctcatcaattccttctttcagcaaattctcccgtgccttctccgtcggtgcaaagagccaatcccccacatgatccgacactacccggttcacctcttccggcatcgtccgatcataactccgcagcccggcctccacatgccccagtggaaccctcatcttagccgcaaccagactcccggcaagaaccgtgttggtatccccctggaccaacaccacatctggccgctcctcttcatacacccgtccaatcccgctcataatagccccggtctggtcggcatgagaccctgacccgacatccagatgatgatccggcaccgggaggttcagttcctcaaaaaaaatccggtccatctcatatgagtaatgctggccggtgtggagaagagaaaaatcgatatttcgtctctggcactcccggatgatcggggacatcttgataatctccggcctcgtgccaacaataatactgatcatatgatgatgagatgaatctttctgcatccgggggatggttcatagggtggatggtcagggtttgtttgaaattacagcccgaaaccccttattttgtactaacgtaaaatatgacctttattttaataaatatatcgtaataactcatgattctggggtatattttgatatcctctctggcaggtgcagcagaacgcgatagatgatatcactgtgaaggggggggttgtcatgatagttcttctcccgctccggtctgaaaatcacgagataccaagtcctccaggagagtgttattctggttggtattttgacattattcaatgaggatgcccaggataacggggtaattctgaagtgataattacctatcactcgaaaaaacgacagagcctcctccctcgggaaaaaatcaggaacacaaatttaccccggaatgagtgtataattttcctggagggttgtagtcaggcggttttcttcccgttgatgtcctggtgaaatcagggtaaaaacgaacaagagaaagacgataatctttcaatatcgctaattttatgtgattttttacaagaaaatctatatggaatcatgaatgaagttcaaaatgaagattttaattcgtcaggcttgaggcttcgcctcataggggttttacaagaaaatttaatttttcattcgtctcgccaggatctccaatgggcaccattaggtttggagacctatttatatgcattaagatttgaactcagaaaaccccccagcccaatcctgacgaagcggcctggccggatgcttcttatgttcttccatgagagaatcgatataaatcttaaccttaacccgaatatccggggtaatgatctgactgcatcttcaattgtactcatacagttctctatgcttatttgttctttaccgattcaacaattttctgttttcagtgggaggtagccatctgctttcaataagaaaatctgagggaatttcaagagactgcatctgcataatgtccatgttgatgaagttctttagtcaaggatagtaatttatcatgcaatttctgaaagaatagagaaatttcttttgtatcagacaatggctatcccgccccgtaatacttcctggatgaataaaaaatcttcatcatggtgcattgttcttcgatcatgaccttcggagatgtcagaacgaaaaaaccggtataaaaattttattatattaatatgacaatactgataaatcaggtattttattgaaatgagaatcccttgtaagtatattttgattatgagcaagacatatcgctgcaatcacttcatcaatatctccgattctattaccatttttcagaagagaggctgaaagctttccaaagatttcctgaacaccagaatcaatttgtaagtgaataaggcttgaaattatttcttcaacctgaagcaggtttttctctatttgtgatgagagatatgctcccttaaaaatttcaagaatgttaattattgttgaacatatcatttcatcatttctttcaagctcttttagtttttcgattgctgcaggatctttttttttaaataatatcaacaagaaatgaggaatccagaactaccattagaatagaacctcacgcatagtgctggaacgcatctcttctgaagtttttttaatactcatggcaagatccacatttggttcataatgagacaggatatctgatagacaaattccttctgaagttatggcctggggatttctgtctcttcctgcctctatctctttcataatttcacttgatggtggctcatcattaactgccatgcatatcagccgctcaatactaatactgtatggttatctggatgctctataaaggactctgatctggatataatgttttttttattcactctgataagttcagcagatgtatccctcagtttccttataggaacacataaacagatctctcctctctggtgggaatacacccggaaatttaatgaatgaatacttagttctggtgaccagtatattctttattggcgatctgtcaaaataagaattatatcatttgaattccataaaaggtgagtatattgccgcgataacataattggagggccttttttagcaatgactttatcgaggcccccttttttgatatacttctaaatattatataaacatagtattgagatatatgatgttcgatatcatccttgaaaaagaagaggatggttactggtctgtccattgtcctgcccttaaaggatgccattctcagggttcttccaaagaggaagccattgaaaatatgaaagaggcaattgaattatacctcgaagtagcacatgaaaaggctatgacattaactaattctcagtctggattatctctcgttacaattgcagtatgaaccatagacttctaccggtttccggagtcgaaatggttaaagtcttcaaaaaaattggatttcaggttataagacaaaaaggcagccatattatgttgtctaggggtgaagattttttggttgtcccaaatcattcaacgattgcaaaagggacacagcgtgatcttatcaaagattcaggcctttctgtcgaagaattcaatgatttgctgaaagaataattctgaatcagtacgattgtagatctttgtttatgagatttacatctccccggatttttaaaagaccctgaaccagatcaatcaaatcaccccagtcaatccagtcgtcctcctctttatatcggggtccctgtgttttagttttcgtatcaaattcttcataggtaatttcgtatttccactccagcaacctgatgtatgtcaacgggataatgagtaatgatattatcttccatctcactttgatcagcatgctgcggttttcgaaaactgatatacaacacatcatcctcttcatcgtaatcacaccatatccgactggatggcagacgaaggaggtcaggtatgagattcaggaccgcatcagtaatagtgtttttcggtttcattatcacattcgagatagttcttttcttaaataatgctgaccagtgtgataaatctgattcgtatctgaatatgatatattatgaattgacccttcgatactacctatccgtagatataccgttcacataaaggcactaaaaaatagaggcaaaattggccgtattttctttttccttatccatcgatcagaaaaataaggtcatattggcgatatttccccacactcataaaaataagtccttaaaatctctcttttgtctaaaaatcagcggaatgcatgtcacctaacgctcaccaatgcacggtatggccacctgttatgagatgatctatgtaatgggtaaaataaaaaacctcgatataatcggtctgtgagaatataattttggacatatataattaacaaagggcaaatgggtataattatcatttgattcgatgcatgccctaccttttatcaactccaatgccgtattttagattgcaagattatctggggcagctttggatgatgttcgttattcatcacgtatttcacgaataatatcggaaaatttgcctttgacctttgcattcaatattcgacgtgcctcattacaatcacatatctctgtctgaatcatactctccagaagttcaggtgggaataaaggtacattctttgtattcctgttttctggtttatcgcatctatctttcatgcttggttcattgtacattcccatccatcatatcctctttctgagtgattcatattttaagttgataacattttattctctttcatgattacatattaaaacttaataaacccacttttgacaccaatacattcacggatgagtcgaaaatttgtatttgatcactccagatacatctgttgtcatccattcatggttcatctcatataaacaatgaaatcttcatgtatccaatacactggtacaggtatgaacgctggcaaacttcccatcggcattcagtctttcaaagaaatccgaacccatggctatttgtacgtagataaaaccccttaatcttccggaacttgacaatcttcttgctggtgaagaactcctcagttcatctgatattgaggatgttcgccctgagtctctcctctttcagaccggctatcttacgataaagggagagacttttgcaggatctaaatgactgtataatgtagggtttccaaatcttgaagtcaaatcagccttttctcagttgatgttgacatccctgacggaaaaagggaatatttctgcaaaccaggtcaggcttgccaacctgctgagggcagggatgtgggtgggttaaaagaggtttttaatcattttctgcctcgattcctcataactggtaacggaaaatcagatatccgtttttgaagagtattatgcaagtatcgtctatgcatatgttgtaagccttggatatctggtcatacctgaagataccacaaatcatggaccggtagacatgacggttcaaaccttatatgctatttggctttttgagtgtaaagttcaggatcagactaatagaggtgcatatcagaaaagtcctcttctgcaattgcaggagaaaaaatatgctgaaaagtaccgaagctgtgaaaaaccgctctaacttgttggaattgtttttgatcctgtgcagaggaatattgttctgttggagacataaaaatcaccgaatgagagtagtggatagattctgttgacctgtatgatactatcgttcggtaattttacgtctcatttgcgtcgcatcaatatgcgtcgtacctgactgaccttcccgttttttcccgttcgatgagttattctctattaagttgtttaactccctgattgctgtatcttttgagataatcaggaggtccacgcattcagttcaagtaaatgaacctcttcgtaaatatttaagaatataatcctctatcagataattaattggattttacacggaacagatctcttgttgaatagagggtcacctgggtacaattttcagttgaaataatggatagcatcgcaggtttgagcgtttgagttccatactcttctattattttatccaacccttcaccaaacggctatacggaatgaactcgtgatagaatgctggtaataatttggttcctggaatattgattgaattttgttatccggagtaatgtctttcatcagttctccaatatttgaaaattcaatcctatcatcaaacatttacccgcgatgaatcaactgatatatgaacccgtaacttcccatgatcatagtaaaaagcccgatggaaaggagatgaatctcaataaacggtctggataataaccctgaaagaaaagcgaagaatattgcagccccgaagatgagcgttgtcattgacgggactttggagaggatctgactgtttctggtaatattacagagtaaatgggagataatacccaccccatgacggaggggattcatcttgtgcttatttggcacatcatatctgacggtaatcgggacctcaaccatcctcattccaatcgaagcaaaatgggttatcatatctgattcaaggttatatccctttgatgtgaagttcaggttctccagtgcccgtttaccgagaacccgaaaaccggattgtgaatcggtgatggcaatctgggatgccagtctggtgacgccgttcagaatctgctgaccggccctccgatatcggggaatctgattcttctctcccatgaatcgtgaaccaatgaccatatccgcaactcctgtcatgaccggagcagcaacaactggtatttccctgggatcatgctgcccgtcaccgtcaaggagaatgatggtttcgatgccgtgtttctttgcataggagcatccgatcattactgcccctgctttcccctggttctcacgtaaccgaattacatcagcccctgcaccagttgcctgttcagcggtattatcagcggatccatcgtcgataacaattaccattgggataatttttcgcgcctctctcactaccgaaccgataatctgcccttcattgtatgcagggatgaggactgcagtggatgaaaatggattgatcggaagatgtccggaatcttcttcaggactaaactgatatctgaaagaagagggtatggtgtgatatgagaaatcatgattatttgaactgatttcggaatggtaccagagatcatcacatgccggagtaatctctccctgaaagcaccattgctcatgtgatgaattcataatatcacaggatatgagtctggaattggaccctcacgtaaaagccccctccattccctgtaagatgttcacctgcatcacttttgagcatttcgaaattactctgccctgatcagaacacaccataatggattttggacccccgtcctgtctgcatcatgatctaaatatatattgtttgaatataatacaatatgatataaatagtttacttctttcatctaaaaaaatgagattgtctttcgaaggaaagagagatgtggaataaaaatcccactgtacataaaagcaggtgtaatgaattcatggaacggtcatactcctggtaataatcagccatgacaatatcaaaaaaacccctgataattggatgcatcgtctcctggcttattattatcatcacattcatgttcctggccagatcttttgatattgaggttctttttattctctggcttattggcattctcatcattgccgaactcatcgatacccggtatgtccgtcccggatatgcacgaatgatcatgatcattgcaggagccgggaccgttctttttggtattattgtgcttcgaaaggtctgggtgatattatacgggtgaattgccaggtaaagcggcatctcttttatcttgtttatgctacgctttgtctccttgttgcaggtcttctgatcggaaacgggctacaaccacttctctatcctgctgagaagagtgtccgtgagaccagatatcatatgaatatcgacgacctccgaaaacaggcatttaacagttccacagatcttctccccctgatgcaggaacttctggactatagcggaacgattgctgtcacgttgagaaaatctgatatcgagtccgcaagttccgatcttgcccggtatacaagccggtaccatgatcttcagaatcttatcatccgactggatatgaatgagagcgaaatcgcccggttttctcaggatgcaggtcagcaaaaggatatgctctcccagttcgtaacaacatcggaatctttgcagtcacttgaaaaactggagattcagtatcagaacgaagggaatcctgaatccgtaaccaaagtcaggcttcaggggaaagcactcaaaaacagaattcagaccctgcagaaccagtatgcagatataaccgattcattgtcatcacgggggaagacccttggagtaaatactgagcccgtgatgcagagcagggttgaatttgataaacttaccgggatggttgcagagcggcagaatgaacgtgaccggtatacccgctttgccgataccggatcaccctttgtttcattcctggcagtaccgaataatgtgacatttcaagacaaggtagatgtgtatgggtttatcgccggatcacagggccgctcattcccggtcgttattactctggataatgagccttttttggaagttatccctaatgaaattggtgaattccgttcaacggtgcagatccataatatttccgctggagaacatatcctcaccgcccgatggggcattgtggtctctgatccgtctcatttggtcgtaaagcctctggaagctacgctgggacttcaggtactcccggtaaaaggtatgtctgcggttaatctgaccggcactctaactgcacgtgacccggttccggatgttccggtcagcatccttgttcaggataaggtatgtgatacggtcatgacgaatgcagcggggacgtacctggtgacggtacctctgtctgaaggaaggtatgatgtatttacccggtttgatgatccctcatatcccttgcttcaatcagaaagtcagcattatatcgttgaatctgacgggacacgtatcacatccgtcaccagttcaaaggccggccctatcccgccgtggatacttgtactacctggtattcttctctttacaattcctatctggtatctctggcgaaaggggatagttcagagatctgtcagccaggttgaagattcatccaaattgaaagatgtacgcgaacagtgggttggtgggagtgcagttgatggtatgattgattcggatagcatccctgcagcggagtatccctccggtcctgaagaattaccccggaaaatatacctggagatgctctcattcctgtcaagtcatcaggtttttgagatatcacctgttatgaccccgcgggagatagcccgggccttgccggaggaggtgtgtaaagcccggttcaccaggtttatcggatggtatgaacgtatcagatacgggggatgtcaggatgtgcggtgcaccgaaggtctgattaaggcagcagatgcggtccgaaagtcttgccaggagatgagagatgaagcgtaatttcattattggattgatgatttgcaccgctctccttatcctggggatatttcttaccacaaatactttggaattctcacaggataatatcggctggaacgggagttcaggattcttctcccggctggatcgtcatacaactgaaatgattactgatatctctgcactggaaacgaaggaaaatacgactcttctgataattgcaccgaatgaatcgtggtcaggtgaggagataaggattatccatgcatttctgaaaagagggaatacggtattccttgcagatgagaccgataccggaaacagccttctatcgggtcttggcagttccatcaggatagggccctcgtatcttgccgggattgaccgggcatataacaactcctcaattctcatcaccagcccggtacaggagcatcctctcacccgtggcattggctcgcttgttcttgataaggcaaaacccctgaccgggggaactcctttgatacagactggtatcatgagctggattgataccaataatgattttcgcatctcatccgatgagtcatttggacgatataccgttctttcacaagaacaaatgggaaatggagagataatcgtcctgtctgactcgggagtttttatcaattctatgtccggaattgaatcagagtatgggaatgggcagtttttatcacgttgcattcagtacaggccaaatcttcttattgaacagattcacagccggacagcggattacagtggcatggggtggttatttcggcatattcggctggattcctttttgaagaccatgatagttctggtctccctcctcgcctgtgcatttcttttcagaaagaggcctccgggattttcagatatcggttctgaaccggtgatgatgtaaagaagagcagataaatgataggatgtattgaaagccatgactgaccgtgatatggatcagaccattgattattatggagatgaggaggatatctctgcacttgcacaacttcatactgccgttatatccgctctttctccatttatcgtcggaaaccaggatctcattgaactcatattgattgccctcctcgcagaaggtcatatcctgattgaagggctcccggggactgcgaagactactattgcaaaagccattgccatggtgaccgggtgtgaatttgcacggattcagggagccgttgatctacagcctgctgatatgatcggagtccgcatctatgatcagcagtcatgtgaattcaaccttcgcaaggggcctatttttaccaatgtcctgcttgctgacgagatgaaccgggttcacccaaaggctcagtcggcatttattgaagccatgagtgagcgacaggcgaccattgatgggataactctccccgtaccccgtccgttcatcgttattgcaacccagaactcctttgaacttgaaggaacctttcccctcattgaggctcagcgtgaccggttcatgttcagtatcggcatctctccgctcagtcctgatgaggaactagcggtaattaaacgggcttcagatggaaccctgacctggaaccggtttgctgaaacactcaagccggtcacatcgccagacgcactgcaggcagccattgcgcaggtttcacgggtcaggatggaggatccaatccatcggtatatccgggatatcgtcattgctacccggaaccatccggatatcgggcttggggcatccagcagggcgtcaatatcttttgtaaaaggggcaaaaggtgccgcggctcttgccggcagggcgtatgtcattccggatgatgtgaagaaaatcgccctctctgttctgattcaccggctgtacctcacacgggaggcggagattgaaggggttcgcccgggagatattatccgggatatcatggaccgtattgaggtgccgtaaccggtgaagctcactccctgctctacgggtctgcttgcagtctttctcatcctcatctttcttgccattatcctggatgatccagtcctcctcatggcaggaacgtcagtcggactactgctcatgggcctctgtcttcaatttcttcatacggttgaaaaaacctaccggacaatcagcggttcatggaagatggaaaaatcgctcattcggcaggggaaaagtaatgccattgattgcaccctctgcctggaaatcccacctggatacaaggttcgatatctggatactgttccggctatgtgcagccttgagtctggagagaaccagacctggactgacattgccggatcacagatcctcaccctctcctaccggtttatccctcactatcatgggaccatatatcatcaggggggtattatcacgattcagaaccggttcttttcaagttcactgccccttcgaccggaaaaatcatcagttccctcagtgcaggtacaaccctggccattatttggtccggttgaaaaacacggatccggaaaggatcttgaacgtatcggaccggtgaaaggatattcaatcaggcagtttcgggaatatctccccggagatgacatccggcatgttgactggaagatatcggcaaaacggggaactctctatatccgtgagtatgcaacgccatctgatgaactccccatggtcattgttgatctcccggatagcggacagcagatcgatatgcaggcattttcacggatggtcagttcaatttccgggtacgttgagtcgaaactagcgaagaaggaaccaattcgtcttatggggatatcaggaccgaatatgagtgatctgtattatgagggatatgatatggcccattgcctgacgataatccgtgaaagaatccatcctgttccccggacatttcatctattcaggttcatgatgcgatcagatatgagaaaagagatacatcacgctgcgttatctatggacaggtcggaaatttctggtgatgaacggtcatatattgtcagggtccgggatatcagaaaacagcatatccaggaagtgaaaaccaccaggtttgcccatgccatgaacactattctcatgcaacggcattttcatgagattattctgtattcactttgtgatggagatatgagtcatatcagggaggtagcagcccttgcaggcaggcagagcattccattccggatacgaaccccgaaacgatccgatctatcaggtatgagtctcttctccctctgtggagaaccggttgaggtgatctgatgactttgaatatggcacggattttctctcttctatctggtattctcattctctccctggttctgtatgcattggtttttcctgattaccaaacctatttgggaatctctctattcgcactgtatgtcatggtgggatatatctggcggcacacaccgtcccaccaattcaccaggttttgcttgggggaaagtgcagtcattgctctctggtttgtctctcctctcctgggtgtgataactgcactccttattactgcagaatttctgaccgggcttgatgttatgaagaaccggaatgggtattccctttttgctctctgggcggttggtaccggtcttttggcattcatgtcagagaggattcagcatacgctcctcccctgtatggcggtattattcatcgccggtcttgttgctcttgccctgctgctctatgaattccggatgatttaccatgcaggagggaatgatttatgaaactcccatctcccgggcgatatgtatttggctcttttattctcctcctcaccgcaggcatatgtgccggagtagtcagcatcaccggaagacaggacatcatctctgcagcacttcttatatcagcagtcatcctctttctgactgcaatcctgcttctggtgtttcatcgtccggattcacttgatcaacgatttgtttcactgctccaggttcagggaactataaatacatgcacggttgctgcagatcttggtctctctggtttatcctgttttctccctcaaagccggtcagaatcacagggtgttatgcatctgatccccgtgtcccgatattctggggaaccggtggccgggtcagtctttgtctccggagaaggcttttcagggctattattaccgccggtttgcactccgctgctcaatgaactgaaaaagaccaatcaactcaccatacccgaaacacagggggaactctcaacactcctgcatgaggtagcggttgatgttctggaagtcaccagcgaaatacagatttcctggtcagataccagtgttcacatccacatggaaggatatcggctgtgtgagggatgcctattcgtgacccgtgagtccccagcctgctgtacattaagtccctgtgttatctgcagcctctttgccacctgtattgcacacggactggataggccggttcaggttgaccggtgtgttccggtaaaaaaaggcgattcggtagagatgatatttactcttttcccgtaaaaatcagggaaggaccctggatattgccgggattttattggtatcgaaaaattcctcgacatatccgtccgggtaggtgatggttgcaatctccgcagtgtaatctgcctgaacgagaggagcaaaccagtatttttgcagtgccttctcagccatggtaaatgatatctccggagtcttcatgaggaccgatccgtttgtttcggtgatatttgaaaaggcctccaccctgaaccgtgctgaattgttcgtgacctcatccactgtcactggatgatggaacatatcttcgagtgcttttttcagttctgcatttggatcggcgatcttcagatagactgcaacctgctcagccatgttcagggtgtattcgaatgcgatatatgcatcgccatcatccagaagatcaactgccagccggtcagatgaaaacgcctgaaccggcccggtaccaatcaaaatgatgagtagtattccacaaattatgagttttgtgcctgttcttctcatatacctgcctcccatcggatatgattgctccacatgactccgatgatccagctataaacaatactggttccaatactttaaagtgcatccggctgacagagacagtcctgtccttcatatactttatttatcctttcttcagacccgcatcttttcagatctgaaattcataattctctggcttattggtgccattacatgtatatacgtcccgattttaaatgaaacatctatcagggtacttctggcactcccccttgttctcttcataccagggtatgccctcattgctgccctgtttcccaccgatgaagatctggaccttatcgagcgtattgccctgtcttttggtctctctattgcagtcgtacctctcattggtcttggtctgaattatacgccctgggggatcaggcttgacccgattgttatctctctctccctgtttacgattattatggtccttattgcccaggggcgccgggcgatgactgatcctgatgaccggtaccagttccctgcagatgagataatggcagggattcgtgaggagttctttccgactgaggggaacagaacagataaaatactctccatcatccttctgatatcgattcttgctgcgattgggacgaccatctttgttattgtctttcccaaggaaggggagaaatttactgaattttatatcctgggggagaagcggatggcagctgattaccctgaccgattgttcatcggggaagagtattcgatgtatatcggggttggaaatcatgagtatcggaatgtttcctatacgattgaagtccaccagataaccatggagaccgatgaatctgggaatgtctcgtatatcacccggatgaatatgactgaccggttatctgtcgctgttcctcataatgaaaccgtgacgttgccctataatctaactgcggcagataaaggatataacaggattgagtttttattatttaatgagtctgttcctgatagatctgtctggggtatggaacggataaaccagagttaccgggatctgcatctatgggtgaaagtattggagtaattttttggaaatatatattgggggttacatttttatcatttaaaaatagttacctgatcttccgattttaaacttcaaatacccgaaagccctggttcccgatacaatatatgacaaaaagtcggattgatgcttctggatattcctgcatgaggccttgtgcatacccctgaatctgtctggtatcttcttctttcaaggggatatcttcgattttgcacttcatttttgagaattcagtattggaaaagtatttgaattcaatcacccagcggaggttcgcaaaccgttcatgatattttcccacgaactcaagatcagatcttccctgaggatatgatcgctcaatgttccagataaaccagtttgagagatatctgctgcagagttcataaaaagtcgtgcggtaaaaattctcattgacctgagtgaagactgcttcaggaaactgtctgatatatagatcccaataattagaaaagagcctctccaaatcaggattatcgataaagtcctgcatcatggatgcataccgggtagatacatcgatatgaaggagttcgttgtaatattctgtaaagatcttcctcatggagagattgggcagttcaagggaaaaatcatcttttctggtgagcatcccaaggtaaaataatgagattggatagtaatttttattaaagaactgggatttgttaaatttcgaaatgaggtattcctcatcatagggtatagtattggttttgagaatgtcggtgagaatctcttcagtattctcaggttggttggtaatccgcttaacccatgacagatctgttcgaaggttcagatccgtaaggttttttggaattattttttgatcacagaattcccgaaggaagaacatgagcattgttgggttatataaggcatcagaattggtatgaacaaaatgatacccgttatactgacttttaataacttcatttacctgttttcgagtggaaaaatccattccatagtctctatatataaaatccagaagttgatcaacttctgtctgggtaaatccaagcatgtgttcaaaggatgggtccagtgtaagaaatgttccaatattataactagaggtgagatcatcaatagtaatgggcaatacaccggtgatgaagagatttgcgatagacccggtttgtcttccatttttaagaactttaaaaaaactcctgaaaaaactttcagttgatgtaatgtccttatacagatgatcctgatgactggtaatgaaatggttgacaaaattatcatattcatcaataattacataaaccggtgggccaccggataattgaattgcatccagccatatcccaaggtttgtagaggctggattatctacgggaagatccggagctgatcccaagactcctgaataagacttttgaagtaatatgagcaggttattgcagtattgtttaaaattatgctcaattttctctattgaattttcaggttcaactctagaaaaatccaggtgtaaaataatatacttgttatggttatgagtgggatgctgtccaatccaggtatggctgaaatatttttcaaaattatctttctctttaatatcataataatacttgagcattgaacagaagagtgattttccaaaccttcttggccgtaagaaaatggggttttttattagctccaattctgatatatattgtgttttatcaatgaaataacggtcttccagaattaattcggcaaaattcattattccataggggatatttttttgcatatttaatagtccattagattgtgattccggtggtaaatatttaacttatacttggttaagggcgataagaggtatgatgaattgtctacggaatgtatctgattgtgatcagcctattgatgaaaggtgccctgaattttcaaatatttgccctctcatcgccagcgttataaattcattaaagttatatcgaacgaccctatggtcacattgacatcttgtaggccgaacgtttttttatgtagagtggtgatgataaaaatagagtaacggtttttattggagatgtatcgacaatttctataatcggattttcattctgttgtgatgacaattaataaatcctgatcaagtcatgacaggctgaaatcgtgccgtatcttcctatttcatattccaaatattttaaacccggtgttacctatgcaatatatcacaaacagccggatatgtgcctcaggattttcctgtatcaagctttttgcatacccttctatctggatcgtatcctctttcctcattttaaaatcttcaagtttttctttcatccgggaaaattcagtatttgacaggtatttaaattcaataaccaatcgaagtccggcaaaccgctcatgatattttccaacaaattcaagatcagatcttccttcaggtatgatcgttcaacgttccaggtaaaccaggttgagagatatctgctacagagttcataaaaagtcgtgcgataaaaattttcattcaccgaagtgaagattgcttcagggaattgcctgatataaagttcccaataatctgtgaagagttgttcaaggtttggattatgaatgaacttctgcatcatggatgcataccgggtagatacatcgatatgaaggagttcgttatagtattcggtaaagatctttctcatggaaagattgggaagttccagcataaactcatctttcctggtgagcatgccaaggtaaaacaaagagattgggtaataattcctattaaaaaattgatttttgttgaattttgaaacaagatattcctcgtcataagaggctgttgcacaaacacaaaaaaagcttaatataaattattaaagcttaattatatatattattaagatcaatatattatatgtctcatcgctataacatgattagaggatatggtaatgaacaacaatttttactccctgtcaatgcgatggactggctatctgaaaatgatattacttatggcatattagaaattctttcgattctcgatattagtccatttattaataaatatcgtgacgatggtcgcggttctgccttttttgatcctcgttcaatgcttggaataataatttattcaatgattcgtggagaaaaatctagcagaaaaattgagatgtgctgccattatgatattggatatcggatcgtcgccaataatcttacacctgaccatacaacgatctatcgtttcaagaagaataattcaaaagaaatcaaatccctttttaaacaattatctcaaattatcgtagaatccgggatagcaagaatcggtgtcctagccctcgatggatcaaaatttggctgtaatgcctctttatcagccaataaaaaattaaaataccttgaagcagagctaggtcggctttttgatgaatcacaggaaattgatgagttagaaaacgatgatataaatattcaggatatggagattaaccgactacctgagcatctttcaacaaaagaaaaacgaaaggaagttcttaatcgggctaaagagaaattaattgaacgacatgatatcgaatctaaaaaacaagaagaaaagattctggaccgcgaaaaagaagaattagaatcgggtaaaaagaaacgaggtagaaagcctttagagcctaaaaaagagccatcttcagattcaaaagtaaatctcactgatcctgaaagtcagataatgtcaaccaccaatggctggattcaagggtataatgggcagattatcgtttctgaaaatcaatttatcctcgctgcaatgatatcagatgagcaaaacgataaaaaattattaatacctatgctaaatgaactcgaagacctttttacgggtattcatccatcaatttcgcctaatatactactatctgatgcaggttatttctcatacccgaattctttagcagaattggattatggcattcaactcatcatccctccttctaaagaaagaaaaattccagaatattcagataatgatgggtatatctcacgaatggaaatgatatgtcgggcgatttgtatgggagaaataatcacatttccggaattgcaaagtatcgggacgtttgtttggcaatcttttatgaacagagagaaacaagcaacaactcaggaaatttgtaaacgagttatggaagtacgtgtgaaatcccccactggtagagagttatatcgaaaacgaaaatacatggtcgaaccagtttttggtaatatgaaacataatatgaggtttaggagtttctctcaaaaagggaaagagaattgcgagggagaattctttttagctgcattagtgcataatataaaaaaacttatcagatttgagggtatagttaaaattaaagaatttgctacgaatattataaaaccgtcaagaggttcaggtttttcctatatttttgcaaacacagtatgtaaagtgggaattgatacatgcaggttcatacatcaattagtctattttggttgatagcttaaggggtagagatcgatcatttgtgatcctgcatgatattgatcattggtgcaacaccctcataaggaattgtatttgattgaatgagatcggtgaggatctcttcagtgttctccggtcggttggtaatccgcttaacccatgaaagatctgttcgaaggttcagatcagtgagattttttggaataattttctggtcacagaattcccggagaaaggacataagcattgtcgggttatatactgcatcgatatttgtgttgacaaaatggtagccattatactggctttttattacctcatcaaccagcttcctggtagatggatcaattccataatcctggtagattgtatctatgagagaattcacttcagtctgggtgaacccaagcatatgttcaaaggaagaaccaagggtaagaaatgttccgatattataactggaagtcagatcctcaatagtaattgggaggactccggtaataaatacgtttgcaacagatcctgtctgtctgccttctttaagcaccttgaaaaaggtcctgaaaaaactgtcccccgatgtgatttcctcgtacaaccggtcctgattcaaggtaataagttggtttacaaagttatcatattcatcaattattatatatacctgggggaatccggatttaagagtatgggattaaataattactcttcttcgtattacaatggcgtttacacaatttctatttgaaatctatgaaatggcaaatgctcgatatcacgagccatgaaacaggattggtaatgactttcatgatgcagatacatgagaatgtaggtcaaagaatataagaaaattgtcgatagtaatcaaacaccaaaacctattcatgatacatattaataatctatactttctcaacttattaattgggagatcctgttactggcaattctctcttcattcctgaaaattttcaccacaattattttcttccaataggacaaattaggaattgcaatactaatttggcaaaaatgatgattcagagaactgccggagagaagctgaaacaattagccattggatttccagctgttgcagtaatcggaccgcgtcaatctggaaaaacgacattagtcagggatatctttccagatataccatatacgctgcttgaagacccggatacccggcggtttgctgaagaagacccccggacttttcttcttcaatatacaaaaacaggggcaattattgatgaagctcagcatgttcctcagttattctcctaccttcagggaatcatagacaacaaggacacgactggcagattcattcttaccggatcccagaatttcctattgatggaaaagatatcccagtcccttgcaggaaggattggaattctcaagttactccccctctccatggatgagttacatcggaatggaattcacaaaaaaaactatgaagattatctctatcaggggtgctaccccagactttacaccgatactatcattccatctgattactattccgcatatgttcagacatatctggaacgggacctcaggcaattaaagcaggtccagaatctctcattattccagacattcctgaggatgtgtgcaaaccgggttggacaaattgtaaatttttcctcacttggaaatgattgtggaataaactataaaactgctcaggattggttatcgctattagagacatccttcattgtatttctggtaagaactcaccacaaaaattttaataaaaggcttgtgcaaatgccgaaactctattttactgatcccggtcttgccgcctatcttatcggaatccgctcatctgaagagattttaaatcatcccatgaaaggcgggctatttgaaacctttatcatcggtgagttcctgaaataccggttaaaccggggatttgaaagtaatctctatttctggagagataagagtggatatgagatagactgtctgattgacagggcagggactgaattaatacctgttgagatgaaagccggaaggacaatatccggagattattttaagaatattgaatattggaatagattatccggtcagaaacctgagagatcctttgtagtgtatggtggtgtgactaatcagatgagaggtcagtgtcatgtgctaccctatgattcattagggccgatctatgatttactctaaaattcccgccattgaaccattatattggtacctgacaccagattttcaggaggattggttggcatttagtttttcccgttgataatcaggccgggggatttcgggttatgaataataatatttcattgtaaattaaaatttatttattttttgtgacattgaaagagtatattgaatgccttagaaatacataataattataaatataatgattatgaatgtaattatataaaattttatggaagacaggatgagttatcactgttaaccatgctccatgagaaggcaccctcatttgcagtcataaccggccggagacgtatcggaaaaacagaacttattaaggaatttttgaaagggaaggatggcatatacctgtatgttgatcctcacaaaaatattgatatcctgattgctgaatatacctcatacattcgagaagtcctttcccttcctcaatatatctcatttccaactcccgaagcctttctggaatttctctttgggattgaaagaccatttatcgtagtttttgatgaattccaacgtttcttagacatttatcccgcttttatttcacagcttcagaacatgtgggatctaaaggggaaagaatcacatctctttctcattgcttcaggttcatcagtcggaatgatacagaagatctttatcgatactaaagctcctcttttccgtcgggcagactcaattatcaccttaaagccattccaggcatctgaatgcttctccattcttgatgatctttgtgtcaacaacagggaagaaaaactacgattgtatctcctctttggtggaataatctattattatcacatacttgagaaatatggttgtcattcttttgaagaagccctggatagagtgattctgagtaatctcgctcctctttctcaggagatgagtgccatgctgatagaagagtttggtgggggtcatacgacatactacgagattcttggagcacttgcagacgggagatctacccagaagacgattgcagatctgactcatattgctccaagttctctccccccatatctcaccgaattatcagatattcttggcatcattgaataccgggtgccggtaactgaggagcggttccattcaaaaatgggaagatatctcctgaaagatccgtttatccggttttattgcaggtatatctatcggaatatgactctgtaccaacatggaaggtatgacctcctgaaacaaaaaatcctggatgaatggaatgattttgccggatggcaggttgaagagatggtcagggaattattggttccccggcttgctactgattatgaacggtttggatcctggtggaacaggcggggtgatgagattgatcttcttgcaatagggtctgctggatcacttgctgtggagataaaaaaccgggagctgagttatgaagatacggaaatcatcctgaaaaaccttgaggtgaaaaccggtatggtgaagagattaacatatccggtaaccctgggcatagctgcaaggactgtagaagggagagatatatttacgaataaaggggttaaggtttttgaactgaatgagttaatctgatccagaaaccagagagatccatcgtgattcatgaacaaaccctgcatagagttttaagggtatttatatcagaattaatattgccgaaactctaattatctcctgatgaaaagaaagagtatcacattaatcctgcagtcaggttttttctgggatgatggaacaaactgcaggttatgagctgagaaagttgaataataatgatggttacctttcgtacattcatttttcgagaagagtaggaaaaatacagaaaattaggtgatactctttcaaatatcagtcatggatcattggaaaagtgatagagccgttgatcatatcgttttttgaccttatacagatcggtaagttttatctagtcataatttattatagattagagggtgttgcatgactaaaatttggaaaatttttggtaagtactttttcttatcaacatctttagaaaattgtctccgatcattctgcccaaagatgataatgcatcggacaatattgaataaggtattctaatacccactcccttattacagataatatgccgcttcttttgcaggatcagttctctgaatttcttcaactcccctcttgaacagaccttccgaagattctgtgttaaacaaatcaaactccattcatcctgacaatgtgatattccccttctctgcaattttcttaaattgcgattttctttaatccatccaaatgcgggttcaacaatcgtttttcgttgtgaatatgtctttttggcaccatacggagtcattgtcacttccataatccctttagcaatagaagcgggtgttggaatattatcatcttgaatgagatttctcgtacaccaatcaccaatagatgctaacgttggaatactgcaaatgccatcaaaaagttgatcggaaattcgttcaagttcaagtaaacttctctcgaggcctctaatactgaaaatatctggttcatggcatgtagaacagagaaatccaatatcctgctgtttcatatacagatagttttcatagctccaataaccagcatcagtaagtaaattaagatattcaagcgataagccggttaattgagcaatttcctctaatctttcataacatggttgaagtaatctgtaatcaacgggtgaattacttaaaaacggaaccagaatatagccatcctggtttacaattatctggccattatatccttgaatacaaccaggcccacttttcattattgaactatcaggatctgtagtgtttgcaagactttgttcatcagggttttttgcaggctttttaggttttctacctcgtttcctttttccagactctctctcctcttcctccctttgggcaatcttctcttcctttttttgggatttctccttatgttcagcctcaagtcgttcttttgcttgaatgaatcgttttatcctttttgagtgagtcttaaaatcatcgggaacctcgttacctgatttatccgggccataaagacgatcctcgacatcatctttttcttggacttcctttagatatttttgaatttctccctcaatcttttcatatggcatgttcgatccaagtgaagcattcgcctttagttttgttccatccaaggcgagaaggacgttattgattaatcctgcttcattaaggagagtcaatactggaatgaaaagttgtccaataaaagaactgtttttcttgataaatcgcgagattgtggaatggtctgggagagaattgcgggttactattctaaatcctacatcgtatctgcatttattctctatttgacggcttgaacgaactccattaaaatatgagtaaatgatcaaaccagtcattatttctggatgataaaatgccgcaccttggccgtcttcccggtattccttatataatggggataggtcgagaattgagattaaatcaattaatatatgacagaaatcatcactcggaacccagtctctaatatcctcagggagaaggtaaagttgttcaaaatcccgacctatcgtattatacattgagtatatgttggacgtactaaggtaaagtacttttgattgaccttagttaaaaaattatggggggatctgagttgtgcaacaccctcattattatttaattattttgatatttcgaagggacaggtttgcgagttattcatggggagagtagggatatgtgtttaaggaatgtgatgattaccacgtttttttgcatcggtttgattacaggcatctttcatgtttcagcccaattaagtgattcaggtatctttggagttcaaaatattggaataccgcttatacctggtcattctggttctgattatatattcattggtgattattcggatgggcagattcggatccttgctccgggtttgtattactgcacagataatatgagaaccacatcagaagactatgcaatccgactcgaaaatcagagcgttacactggatggaagtggccaccaggtcatgggttctggaggattttgtgatggtgtgcaaatcctgccagagagttatcagtgtattattagaaatttcagtctgatttcagatttttaccatggtatttattctgaaggtgaatacgcattcatacataataacacgatcagaaatgcatcagcccatggtattcaatcaagaggaaattattcacagatacattttaatacggttgaagatactggtgatgtttgtatcttttcatatggtgataattcatctttatatcataattatgtctttcgggggaggaacgggatattaaatcatggaaatcatgcagatatctcaaggaactatgctatcaataattatcgatatgggattgctgctggaggtgtctatgtaggtcctgatcctggtgatacaggaaaagggtactatacgatcatgaaggataatattgccctcatgaatgggtatagtggattgatcagctacatgccgcatggggttgttcacgacaatattgccattcagaattctcgagctggaatagatacaacagctcgtagtaataatacgactctttcaggaaatatggtggtgaacaattctctcggtatcaggatatctgaccaggcacgagacctcatcgtacgacataatcgtatcaccgctcatacacaggctgacctctttattcttcagaataacagttgtgggtatggtgcgatatttgataattactttgggagccttgtgcatcttgatggagcagggcatatagaaaatatcacctggacaaatccgaatggaccgactccaggtaaaaacatcatatcaggaccatttattgcaggtaattattggagtaatcctgatgggaacggctggtctgatatccaggctccatcagtgaccgggtattcgcaggttccctacgaggtgaagtctggccagggtgtgtatgataccgctccactagtcagaatcggtcataatgtgtcatcttttgctgatgaatggacaattatccatcccattggaaatatcacctatccccggtattcagatccatactatataacacaggcaaaacccggggctgtattgaataatctccgggtagatggatttttgaatgcatcggctccttcttataccttttcatctattgatcaggatcatatcatagaaacgaatggcagccctgaacaggatcaggttcatgtccggtttacgtactcacccagtgttgggaactatcctctgaaagtgcaatttactgataattcaattggaagtccgaattcctggtactggcagtttggtgatggcagtaattcaacagagaaggatccggaacatatatatatgattcctggacggtattcggtttcactcagagcgtttaatgatataactgggggtaattcagtctgtaataattgtattaccgttctatagttggatgatgcagatgagagtcttgctattcacccataatttttctcatgtttttgttgtaatgtctctttaattttgcattaattatggatttttatcgcgaaaagaatgaattattaattgaaatctcgatatgtgatagataatataataatgttatacatagaagaaaatgtatggatgggctacattcaggactaataaagacaataatctgtgtgggtttagtactccttctgggagggctcattcctgttatggctgaagaacagcctgacctgcatcataagatgtttaattcaggagtaaaaagttcgctctttttggaagacagggatgtaaattactcccgagagaagataccgtctgaaatgagtaattatggtccaagaatggaaacccggcaagaaaatacttcactcttttccactgccggaatcccggttgtagagcggaactggcagagatcagtaggaggatcagatgatgaagggatctggtccgttcttcatacaaatgatgggggatatctaattggagggtatacatattcaacagatggggatgtcactggaaaccatggatgggatgatgcctggattgtgaaactgggtcctgccggcaaccttctctggcagaaatgtctgggcggtactgattttgacagcgcacgttctaccattcagacttctggtggcggatatttagtgaccggatttacggattcaaatgatggtgatgtctccggcaatcatggctggtcagacatgtgggctctgaaaaccgattcctcaggtaatctggtttggcagaaatgccttggtggaacagatgatgagagttctcgttcggtcattgagactactgatggcgggtatcttcttgccggatacacctggtcagatgatggggatgtttcaggcaatcatgggttgtctgattattggattgttaaaatcgataacctcggcaatctgatctggcagaagtgttttggtggttccgaatacgatcatgcatattcagtcattgagacatctgacgggggatacctggttgcaggatattcgtattccactgatggcgatgtctccgaaaatcatggcaacagtgattattgggtaataaagattgataaatccggtaatctgatctggcagaaatgtctgggtggttcggattttgagtatgcacattcagttattgagacatctgacgggggatacctgattgcaggatattcgtattccaatgacggcgatgtctccgaaaatcatggcaacagtgattattgggtaataaagattgataaatccggtaatctgatctggcagaagagtctaggtggatcagatgatgatcatgcatattcagtcattgagacttcagatggcggatatctgcttgccggatattcctggtcagatgatggcgatgtctctggaaatcacggatatgctgactattgggtagtaaaacttgataattccggtaatctgatctggcagcaatgccttggtggatcagactatgatggtgcatatagagtagttcaaaatactgatggcagatattttattggaggtgattcagaatcaaatgacggtgatgtttctggaaatcatggctggagtgatatctgggttacattggtctctccaatgcattccatttccgcttcgtctgatccttggtcgcttgtccatccgtatgggacaaaatcatatgttgaaggaacgaatgcactgtatctgactcagggaaaacctggtgccatccttgaagatgttcaggtggatgaggtttcacaggggaacatctcacattacacctttactgatatcaatgatacccattcgattaatacaactggaacgcctgtacctggccaaattcatgtgatatttactatctctccacaatccggaagtgttcctctaacagtcgagttcaatgatacttctataggaggaccttcatcttggtactggcagttaggtgatggaacgagctctccgttacagaatttgacccatacctacaccattccaggaacatacacggtctctctccgggcttataacagtcagaccggtggatatggagtatgtaatgattgtatccaggtaaattcttaatcttatattttatcggtccgttttagaaaattcttcacgaatgctgttttgtaatttcaaatatacgaaaaccaatgttgcctatgcagtatagaataaacatctgaattctggcttgtggatattcctgtttcaggttttctccatatctaaggatctgcgatgtatcctgttcctgaagatccaatgtttctagtgggattttcagttttttccattcagtattggaatagtatttgaattcaataatccatctgaggccagcaaaccgctcatgatatttccctacgaattcgagatctgttcttccctgtggatatgaacgctcaatattccaggtaaaccatgaaaagaggatctggctgcagaacgaataaaaagttgtccggtaaaaattttcattcacctgggtaaatattgcttcgggaagtttcttaatatagagttcccagtatttggaaaagagcatgtgaagatccggattccttccaaactcctcctgcactgctccataatctgttgttatatccatatggtttatctcattgaaatattcaaccatgatggcccgcattgaaagattaggcaattctaatctgaattcatctttttttgtcagcattccaagataaaagaatgagatcgggtaaaagttccgttcaaagaactgactcatattaaacttagatacgaggagatttctgttatactggatagtgtcctgcaccgtcagttcatggacaaattccccggtcgttttcgggttactaccagtaattctttttacccaggataaatcagttcggaggttcaaatcgataaggtctattgggatcttctgttgctcacataggagatctagaaaatacatgagcatggtaggattatacaatttttctccttcgggattcacaaaggtatatccgttatattggttttttattgtctcttctacctgatctcgcgaatcagaaggaagggaataatcgtgaaatatcctgtcaaggagatgatttacctcttccttggtaaatccaagcatatgttcaaaggttggagataaggtgataaattttccaatattgtaactggaagtcaggtcatcgatggtaatcggaagaactccggtgataaaaacattggaaatagctcccgtttgcctgcccgcttttagtactttaaagaatgttctaaaaaaactgtctccggaggttatctcccgatacagatggtcctggtgagtcgtaatgagctgatttacgaaattgtcatattcatcaataataacatacacctggattgaatgcgtaatggctattttatccaaccatacagataaattggtggaggcgtttccttcaggttgaaccggtggaaagtcttttaatatatcttcataagcagactggacactgatgaggagttcattgcaatatcgattaaaattatgctcaatttcagaaaaattttttgagattggaatcgttgaaaaatcatatttgaggacaatgaatgtattgtgggtataagtcgggttttttccaatccatgtgtgaccaaaaagtgtttggaaacgccctgcttcctttttatcataataatagtgaagcattgagcagagtagggattttccaaatcttcgtggtcttaaaaaaaccgggttgttaacgctttcaaggtcatatatatatttagttttatcgataaagtaataggagccattaataatttctgcataattcatcacaccgtaagggattttttgtttcatgttttcatcaaatgtatatctatgtgagttcctggtctggatccatgcagctctttttgtctcaattcatttataatttgccggtaggttagtgagattggaataattctgcctcattatttctattatctcttgtattattcctattttttatagttttgcaagaaaatcattttcatcgatatatttattagatagtatattaaaaaactcattaatctatatttattcaagggggagtaatgaaatgatggggaattttttcaaacttaaaaacattttattggtactttttgtacttattagcataacattatcctgttatggggaagaaaatgcggcagatgttcctgtggcatcatcagctccaattaatccagaatacctgaagtatttggaaagggttaatgctttaaatgagaccggtgaatttgcacttggctatgaacctccggtgatttcatttgatcatctgattgggaaacgtccctttgattcaaatgttcaggatttgtatccttcatcgtatgatctcagaacctttgataaattaacaccaattaaaaatcagaatccctggggtacctgctgggcatttggatcacttgcatcacttgagtcttcactgaaaccaaatcagacttacgatttttctgaaaaacatgtagtcaatcgcaatctctggctcactggtcctaataccggagggaattatcttaaatccggaggttatcttgtcgcctggatggggccggtgaatgagacgaccgacccgtatcctgttgacacatggaattatacttccccttcaggtcctataacgaaacatgttcaggaaatttactggattccaggtatggctaacgcttcagatctggagacaattaagagttcaattgtaaacaatggtgctttgattagttcgttttactggaatcccgcgtcgtataatttcacccataaatcatattactgtccgacatgttcaggttccaaccattgtattaatctggtaggttgggatgataattacaacaggaataatttcaccactcctgcgcctggtgatggtgcatttctgcttagaaacagttggggtaccagctggggtgatcagggatatggatggatatcgtatcatgatccgacaattgggaaatacaatgcccatatctttggttcggatgtgaatgattattcgggtatttatcagtatgatcctgctgggacttcatcgtatattggcattccctcaacaagcatctggggcggaaatatttttactgcgacggcagatgaaaaccttaccgcagttggtttttatacaaatgatgtctctgctacctacgatgttcgtgtttataaaaatccaacagcaggagggccagttggttcgaccattctttcacagaagactgggacaataccgatgagtgggtatcatacaattagtcttgatacaccagttttcctttccgttggtgatatcttttcaattgttgttcacttgacaaatccaagttatggatatccacttgcagtcgagaatcctgcttctgggcctattggtaatacatggtctgcaaatccgggtgaaggatatgtcagttcagatggaaattcctggactgatatagtaacaattcctggttttgtaaataccagcatatgcattaaggggtataccaatactataacacctcctcctgtagccaatttcacctcgaatgtgacaacaggtcttgttcctcttactgtccagttcaccgatacgtcaacaggcagtcccacgtcctggctatggaactttggtgaaggaaatacttcatcaagccagaatccggttcacacgtataccactgcaggtttgtataccgtaaacctgactgcttcgaatgccggtggttcagatacaagagttgcaccaggttatatcaatgtaacaaatccggtcccattgcctcctgttgccagctttacctcaaacgtcacatctggagacatccccctctgtgtccagtttaatgatacatctaccggaaatccaacgtcgttttactggacatttggagatggtgcaaatactacaatccgaaacccgattcatacctatgaaacacccggcctgtataccgtaaccctctccgtcgcaaactctgctggctctaacctgacgtcaaaagcgggttatattaatgcaacatctcctcttccgaatccattcgtgacaggtatctatccgaattttacaaaggctggaatgaatgtaggatttaatcttactggtaattatttcagtgaaggctcgatagtcaaccttaccatgagtggttatagtaatatcactacatttggtaatctgtcaggaagcaatctgactggattttttgatattccatctggtactgcaacagggatgtggaatgtcagtgtgaaccgctttggtcagtatagtaatgataatgttcagtttcaagtgctgccacccgttcctccggtagcaagtttcattggaattccacgtactggtgtggccccgctgtttgttcagtttgctgatacatccactggcggtccgacatcatggagctggagttttggcgatggtggtctttctaccgatcagcatccaagtcacacatattctggagctggtctgtatacggtgagtctgaatgtctcgaacagtggcggttccaatgttacgactgctcctggttatatcaacgtgacaagttctgttgttccacctgtagcgagttttactggcagtccccgtagcggtgttgccccgttatcggttcaatttactgatacatccactggcggaccaaccaactggacctggagttttggcgacggtggtctttctaccgatcagcatccaagccacacatattccggagctggtctgtatacggtgagtctgaatgtctcgaacagtggcggttccaatgttacgactgctcctggttatatcaacgtgtcaagttctgttgttccacctgtagcgagttttactggcagtccccgtagcggtgttgccccattatcggttcagttcacagattcctcaactggtaatcctactacatggaactggaactttggcgatgggctttcatctacgatgcaacacccaatgcacacctatgcaggaccagggcagtttaccgtcaatctaaccgtatcgaatacagcaggaactgacaccctcacagcaccagattatatttcggtttctggacctccctcacattattcaattaacgcaagttccggaccaaacgggcgaatagatccctcagggttaataattatccctgccggtggaaatcagagattttccatgatttcggataccggttatcaggtcggtgatgttcttgttgatcaggcaagtgttgggccagtcggatggtatgaattcaggaatatcagtactaatcataccatttcggtcaatttcgagagaatacctggacagaaattagtgaatgcttcggcaaaccgttggagtatcgtgtatcctccaggtatttcagcataccaggaaggaacgaattgtacatatattactcaggcaaaaccgggggcagaaatgaaacagattttaattgattcagtcgaacagaatctttcagaattctggacatttacaaatatttctgatgatcataatatctacacatatagcgaaccaatacctgatcagatccatgtattcttcagaggggcaccttcaactggatcagctcctctgggcgtgcagtttattgatgaatccattggtacccctacgtcctggctctggcaatttggcgatggtgaaaaatcatacgatcaaaatccatatcatgagtaccagtcacctggaatttacaccgtaacacttcgtgcatataatggaaagaccggggggtatggtgtatggagcgatggggtaatcgtcaaataattttttcatcttggattattttatgataaactcaaaaaataattttcatgctttttttcttaaaatatgatttaaaatgggattaaggcaagcgcatcgttgaatattccacttgtatttgggttgtgttcttttaaattaccaataatgatatagattgagttgtcattatagaacgaatagaggaaaaaaatttatcttgttaatatattgttttgtactcagatttaagaaaaagattcctcaatcgttttttaaaattaaaagaaaaaaatagttaatatttcatatatctttataacccataatctatataacctattcaataattaatactattatcctgatcaagggaatgatggttatttggtggggttataatgatagagagtaacatcgaaaaaatattttccaagacctatttggtaaaatggttagtatgtcttctaacctttttaatgtctttagttttggtccaacctgggacagcactattgtacccgtctttttatgggatgaaccaggcaaatatgactctggttgtatcagataatttctctcaggataatctggcatatggagattttttatatctgtttgataccacgactgcaagtgccggtgattcagttaatacgagacattggaatattacggtaacagaaccaactgcatatagtggatcacgtgattcatatattccaaatccagtattcggtccgtttttaaatgaaacttcgattattgtaaatcttacgttaacaaacgccacatctgtcagttataatggaactgatgtgtaccaggttatagatggtaggaaatggattagaccatcatattcggtaaccgctgatttccgaaacaaaacagcaactaatccgatagggacaatccggtttaatgacacttctgaagaactcctgtttccgatggcagagatcaccgattggtggtggaaggtaaccgataattctggtgtaccacaaaacacgtcaggttgggataattttacagtcaatatgactgataccgattattatcaggtaaatctgaccgtgaggaatagtcaggggaatcttgcctccttatctgggtatactggagctccagaggatggaaatggtcttattgctaattttgctgcagtacctgttgctggaactgctcccttaaatgtgagttttattgatctttcatctggggaaataacaagttgggattgggattttgatttcctcggtattgattccacgaatttacatagttcatataatcagaatcccactcatacctataagaaaccagggatttattctgttaatctcacaatttatgagggttcgaacagtaaatcttgtctagctggagacatgatcacggtttatcctcctccggtttacctggctgtagctccaacaaaaggtgagaagccattgaatgttacggttatttcacggtcctatgggctgaatgcatcaccaatatatgaatgggacttcggaaatggaatggtagttaataccacaacaccttcgtacgtgtatacctataatccgggtggtgtgaatccatctcaatcatggaattatactattcgtcacaccgtgtattctgacggggttgcgtatcctgcgcaaaatacccagaatgtaactattgaaacacctgctccacccagggcacgatttgcagcggttccacaatctggaccagccccgctgaaagtatcttttgttgatcagtctgaagggaaagaaccatttgattatatctggaatttcgacgatggaaaaccgaatgtgtatgatgttcagaatcctacggtaacttttgagacgccgaaagtctacaatgttacgttatactttaatgcatcaaatggtgctgatcaggcgtatgttctagtgaatgttactgaacctgttcctccagtcattgatttcgccgtcgcgccgacaaagggttataaccctctgaatgtgacggtgatatctcagtgcagcggtctgaatgaatcccctgtttttgagtgggactttggtaatggaacaaaaaggacgactactgatttatcatatgtgtatcagtacaagccatatagtccaaatccgaatatggtgtgggaatatccgataaatcttacggtttactcggatgggctgatttactatgcatcgaaaagcagaaatgtgactgtggaaaatgcaccaactccaaaagctgcatttaatgcttatccccgaatcgggtcgagacctcttgaggtttcattctttgatcagtcaattggacaggaacctatcaattatgagtggtattttggagataatactccaaaggtatttgagcagaacccggttcatgtgtacaatgaaactggagaatttaatgttactttgatgattcatgcgaagaatgggaatgacataattaatcaaactggtttaatccgcgtgacagattatccgattcctaatgtatcatttagtatggctcctgtgagtggatacgcgcccttgaaagtatccttcattgatcagacttgtaaacaggactgttcatatgaatatttctggcagtttggtgaaggaaatacttctacgaaaaggaatccggtctgggaatatgtgacgcctggtaattattctgtaaatcttactgtgacggataagtatggagtcagtggaaaaggaaatggtctggtgaatgttacagtcatgcagccttctggtggggatgatgggcagttagttgcgaattttactgcattatccacaagaggagtagcaccttttgaggctcattttattgaccagtcaagtggcaatccaaaaggttggagatgggattttagtgataaaaatgtttcatttgatcaaagtccaaatcacacttttttcaaacctggaatatacaacgttaccttagaggtatataataagacatcgtattcatcaaatattacaaaacttgattatattactgcaatatctcccataattgatgcatggttttcatttcgatatattggtgatcaatcaacccgccttgttcaattttttgatggttcaaaaggagttggaataaatagctgggaatggacatttggggatggaactacttcaacagagatcaaccctgttcatttatatagttcgaaaggaatttacaatgtaaaattgctagtatccaatggatatgctaaggatatttttgagtatgtagtttacatttaataatcctttttgcatcttttttgattattgctacagaggaaatttagttaaatttatatattattttttatatagcataatctattgattgtttggtttttgtggtctgaccatgatcaaacatattcattgggggagcaattcaaaatgattgaaaaaacatttgaatttcaggaaagaaattctaaactacaaaatcgatggggttttggtattgttgtactgatgtgttctgtactttgtttaatcattttttctaatattgtatcagctgaaatgacaatcagtggtcctgattcggttaagcgggggaatgattcttttacggttattgttaatgaaacagttcggccatcagaatcatattattttggtttgatcattaatcctcaaacaatgactggtgatgtatgcgatagacctccctacattattgatgattttatttattcaaaaataccaggtcaggcatgggatgcatattatgagccggaacaggataaaggagaaaaattttatgaattatctcccaataatctctcgtacccatcaaatagcacatgctgggatgttccatggaatggtacgcattatatggtagaattatgggctgatcaatacaataccggagattggtatttaacaccagatggaatatggcaccatgatataaatattggcttaagatatccggatttttcaacctccgtgaaacccggtgaatatacttttcatgttcaaaaagcatcagctcatcgtaaaccaaatctgccaaaaccagtaagtccagttcggaaaattgattttgaggattataaggtaaatattgttgttggtggttttgacttttctttttatgattattcggcatattatagtataccacctgaattgatacccgttaactcagctggtaaaggtgaaaaagttatattgaatggaacaaattttgatagcgatgctatttatctttggattactggtgaaggcttaccgaaatgtggaacgtcattaaaggttaataatttacccgtaaattctaatgaccctcttattgtaggcttcactgatcgaaagaatgggacttgggaatataaatgggatatttctgaaacaattcttgagcctggcaaatatacgatatatgcatcgacaattaatcccgatgatctagtaacagaatttttcaatcgtccaaatgaatgtggatcaatttgtaaaacacgagaagaaggtgtttgtgcattactggattgtcctacctgcacctgtttggcaccaattatcaaaaaagattttacaattactgaattaacaacgaatattaattcaattgataaggttgaaccctgttgttgccctggttacccatgtgggtttacgtcatctttggtcaatattacattaagtggtatatttggtgattcacgaactcccatgcagatttggatgtttggtaataatcaaatatatgataagaattatctatttactgataatttcacgaccttcctggatgcagatggaagcttccaattagatatttatgagtatttattaaagccaaatgggttagatttatgtgatttggataatggagagtattatttacttgttcaactacccggacaaacaaaccagtcaaaacaagtttttgatgttacattagaaaattcaacattttataaaaaaatctccactttagagccgaatacatttttaatgtctaacctcacaaaagacaatctgtatgttgtaaagtcagatccatttttctggacaaaggcatttccagttttaggtccgaattcatatactggtaaacgagcctttgataaattaacaacccttttagatgaggcatgggtcagggaccgatatgtgacaacatcattcttcctagaacctatccgttgtaaacaagatgctttaagcttcattgctaccccgcaggaaggctatgttccattaacggttcaatttacagatcaatcaacctttaatgggaccgcttattcttgggattttggagatggtttaacatctacagagaaaaaccctcaacacatttataataaatctggaatttatgatgttacattaacaattgagggtacagggacagacggaaagcagaagaatccgttaaggaaatacaattatattattgtacgggacattcctgcaaaatattatgatccagttgcagactttaccatatccaaggttgcaaatgaaccattcagtattcagttcatcgatcagagttatggtgcaaccccgctgacaagtatctgggactttggggataactcaacatctggagagaagagtccaaaacaccagtatgcatctgctggaacatatactgttaatctgacagtaaaggatcagtatgacaaagaatcaaccaagactcaggacatccttgtcccatcggtcagtcctccggttcctgactttgaatttactataaaccccaatcagatgaaacaggtgcagtttactgacaaatcccaaggagagatcacctcatggaaatggacctttggtgacggtctgggctcatcaatacaaagccctgaacacctgtataccacgtatggaacattttcagtcactctgacggttggaaataatgccggttcacagtcattcacaaaggaaatcacactgatcgatccaaaggtctctgcagacttttcatgggaagatattggtgagagaaccgtgaggtttttggacaattcgaaggggctcatcaccgagtggactcttgagtatggcgatggcaaagtcgaccagttcacagaagcatgggatgaagtcgagcatacctactctcaactcggcagatattatgcgaaattgactgttaaaaatgattataataaagattctgttacaaaacagatcgatgttctcaaacggcaataaatatctttacaatctctctttttctcttttaaaaaagtgataatctttttttttcttcagtattaaaaaagaataatagaaatatttatattcttcattaaatatatgatgtatattatcacagaatgggggctattgagcaatcaatttggtgagatggaggaagcgacgacaaatctgatttgaattttttcaatcggtattggcggtcatttctttcaggttagagaaatctcatggatggagtggtgttgatgaaaaaagacaaattaatcgattttaagaaaggtctgttcgcactcatggtgctctgtggtataggcattctccttataccgcaagtatcggccgcagggattaatattaatgttccgattgtagaacagaataccacggttttcattggtgaagaagggcttgatatatcaaatgcgctgatagatccaaacactggaaacccggtatatctcctcggatggtggggggatgatgttgaatctggtggacatacatcagcagataaatatatcacgatcgctccggggagtgtgaccaactattatgtcaacccgactgagtatatgatgaataatcgatacacagagggttctttttatatctgtgatgagactactggtcaggctatttattataatggataccctgttgtcgctttttatgtagagttacctcatcttgaactcgttccggctgatgatgtatgtcctgatgtaaaccggaccgggcaggtcttccttggaacaaatctgaactttaacattaagaccaacctgtacaagattcagaacaggcctggaggtcagaacagcgcgatatttgatatcaatgtcatcggaccgaatggaaaggattacaactacctcctcggtcctgatgccggagggtgtaactgtccggattgtaatccgaattatccggcaataggtatcaaggatatcaatattctgaccaacaagcatcagtggcagacttgggataccgatgcaatcgatccacaaaccggtcttttgtattcacctcagggaacatatgccatatcggcaacctgctgggcaaatcacatattagacaattacgtaacaataggtggggcaaaatcagccacaacaaatctggaactggttgtagagaccgtgagtgttacggtaaatcctgggaccattctaagaaccgaaacggcaactgccacggtgacggggaaaccacagactgagtacatcatcgctctcatggaatgtcctcttaagatgaccggtgagatctgtgaccgcccgccatggtttgagaatgatccacttaatgttgcgttgcagtttgatcctgaaggcggtccatataccataggaaaagaaattgtctatccgtcctgttgtgatgggctaaccttcagagatgtcgtgccaaaggtataccatgacggtgtgctctattatgcaagtattaccactgactgtcttggaaaagcaacgatagacatcaaagtggataatacggtctggaaagcggataataaccctgtatatacgatccatgttcagaaacgtgctcccgaatgtaatggaattcacctgtttgcggagactgaattaactgttaaaaagggtgatatttccatccagatctcacaggcatcagatacaacaaatgcacccatcactgaggcatatcttggtgataccctcaagatcgctggatcaaataccgacagtctgagaacctatctgtacatgaccggtccatgtcagcctgaatgtggtggaggcctgataccgattccatatccacatggaccaattggagatggacctgaagtcattgatgtaagtcttccacccatcgaaggatttgactggatatttaccaacaatgatgccactggaaagccacggtactgggagaccagatacctgcctatgaatccagggacctataccatatgggcgattagtaactggccgccaaactgtccaaattgtcttgattgcggtggtcatccgtgctttacaaacccggagacttgtcctggatgtgatggaaaggtatgttcactccttgattgcccgaactgtgatgtgtatgccgttgcaactatcgaactgaaggctcctgaacttaccgcgattactgaggatattgagcggtgctgttgctcaggatatccctgtggaaccaccatcgatagtcatcctatcaacgttagtggagtttcaaccggaaatccgaagaaagagctgaatgtctggctctttggcaaaggaaagatcggcgacgagaagttcatgaacataaaagtgcctgtcaattgtgacgggacgtttgtatttgatgtggtgaaagatattctcggatattatggtattccattgtgcagaatagattcaggtacctatgatctgatcattcaggatgcaggatataatcatcagtatgatgtcatctatgaggatgatcttgatccttcaatatgggccagacctgtggaagtgaacaaaaaatggatcatcatgggtcatccagacatcggtccggtagagaattattcagagattaatcctggagaacaaaatccaaatgaagatttccttactcatgtggatacaacaactttagttgttcccgatccagactcccagaagttctacgacgacgactggcgtaaactcgtccaggtagaaggaccggggtacaagctcggaactgaagtcctctatgctctcatcaagggccttgacgatccaagcgttgacgacaactatgtccacatccagttcaccgtcacagacaaatcctgtctggttggaactgactttgatgcagatcggacttacggaaacaaaccgctgaccgtccggttcactgacaagagttacaatgcaacatcatggctctggaactttggagatggaacaacctccactgaacagaacccaacacacaccttcactgaagaaggccggtatacaatcagccttaccaccaatggtgatgagaagggtaaagcagtaaagaacgattacatccgggtagcaaaaggcccgactgcaaagttcgcctttgcaccaaaagatgtaacggtaggaactgaagttcagttcactgacctctcgtcaggtaacccgacctcctggatgtggcactttggtgatggttcatcctcaccactccagagtccggtgtatacctacatggcccctggtgtgtatactgtcatgctcacggtgagtgatgaaaccggaatcagtggtgactctgcaacccagaccatcacagtccagggttcatcaaccccggtcgttgcggatttcaaaaccgaagtaaccaatggaaccaatgtccagttcactgacctctcttcaggttttggcataacaagctgggtctgggactttggtgatggatcgacctcaactgagagaaatccgaagcatacctaccttaaggaaggaacctatcaggtctctctcaccgtctcgaatggcagctatgaaaacactgccaaaaaacccattggaattcgttaatcgatcctcatttcttttttacttttatttttatactatccgcaatttctcatcatgtggcacctctgaaaataagagcaaattaagaatatttcaaagccccttatttccgcggcatacatgcatcagagcgatctgaaaaacctgaaagataatagtacctttccgaattaaaatcatcagtgaatttttctctttgaaatcacaaggaaagcattcgtgatttttcgatttatctacatatattggaaaaaatatatatcatcttgtgaaatatcttcgatgcagttttcgatgcttcaatgtgtaatataaataggatatatttcgaaaaaccttatttttgagatacttatggaaatatttatattagaaataatatataggatttttattatctacgtatgggagttgaatacgccacagaagctaccatggggtgtgatagacagatcggtgagtgccatacctgtatcattctggtacggggatgatatgagatctgcctgaacgtggggtgttttcagatgagggagaaaatgaacagatatctactaatggcgacatgcatcgtcctgatgacatgcgttgcgatagtatctgctgaatcctttgataatattgatcaaaatctgattatcaaacagatccggcaaaaccatactgtctactttggtgaggaacacctggatatcaccaattgtctgggtggaaacgggtatattgtaacgttggatgtggtcagaaatgtgacagatcacataaaaataaatgatccgactgacttcaatatgcccacggataaagaagagaacgtctggtaccaggcacgagatgcgaaaacaccggtattagatccgcagggaaatccggtcccggcattcattactcaggaaccggttctttcattcgatatctggaatctgaatactgacatgaaagcgaacgcttcggtccagaggggtacgcttcttcagttcaagatgaccaccgatacgaacctcgatgacataaccagtcgtcttgattacactcccggtcagggatatgtaaatatcggtgtacgagcacctaatgaaaccaatccaaaagatccaactggggaaactcttttaaaattaatgacgctcgggaaaaactccggtgatgttgagattaaaccgacaattaatctggaagttgatccatcagcagcatgggtatggcctgaaaacctgaactctgaaaccgcagatccaaccgggtggatgaccggatggcgtgatgcaggaactggtgttgagactgattacaactacaagctgggaacctatgatgtgaccgctgtctgtaatgtcaacaacatgttcaagaaccgtcagcgtcagggctttacctgggattcacagaaagtggaactgacagcacgtgagatcaaggttgatgtatctgcaccggtcggaaagagcagagatgtccagtttaccgcaacggtaaccggtatgccaaatacgctctatgagatcttcatttatgatgagtgtccgccgaaaatcagcggaaagatctgtgaccggccaccgtttattagggaagaccgagcagctctcatggggaaaggcatcgaacttgatccgattgacggaccatatccgattggaacacggcttgttgtggattgctgtacccagggtatgaacatccgtcaggctgtaccgtcaggagatgcattcccgtcacagggtaagaatgtctttgagaaaggtactcgctattatgcacaggtcagaaccggacctgatggaaaggttactgttccattctggattgataccacagtcggtcctggcacctacacgattcaggcacaggatatcctgtataacctgaagtcaactgccaccattactgttcctcaggggactattaccggtgcaacaaaggatccggccggcgttgccaagaccgagttctacctgggtgatgagatatggatcgatggtacaaactctgacagcaacatgacctacatctggctgaccggtccaggtctgaacccctgtggtgtcaacctcttcagcccgcttgacagcaatgatccggtcagagcagttgtctatgacaccaaggatggaattgccaactactggcgtgtggaaccaaactgggacacgggggctgtcccgattagtgaaggcaagtataccatctggatggcaagtgttgatccaggatgccggttctgtcagtgtgatgctgccggaggcggagaatgtggatttggtgactgtttcggagtagcatgtgaggaaggagtatgcagccttctcaattgtccggaatgcgcagcagtatccagcattgatgttacactcatcaagcctgacataaccgctgaggtggatgatgtaacccgctgttgttgtcctggctacccctgtggtcagctgggtggagtccaggagatctggattgaaggaagctcaggcggtaactcctgcaagcagcttcaggtctggctctttggccagagtcagttcggtcttaagaattatctgatgacagtaactcccatttactgcgatggcacatacaagttcgaactcaataagggacttctgcaggcaaatggcattgacctctgcagcatagcaaccggtaaatatgatgtgattgtccaggcacccggagcgaacaataactttgatattcgccttggagaacctgaaaacacgggagaccggtttgtcctgacaaccatgccaactgatgacagcaaattattcaagatagagggcaaggattccctgtatgcaggagttgcagtcaaagctctgattgatgggtttaaccaggatggcattgatgacctgtatgctcatgtgacctttgagctgaaagacaaggcctgtgaaggcaatgttgatttcacagccgataagacacagggcaatgctcctctatcagtgcagttcactgacacgtctgttatgcagggtgtcagctgggcatggactgcaaatggtgaggcattctcaactgagcagaacccgaagaaggtctttgacaaaaccgggaagtatacgattgaactgaccgtaaccgatgcagagggagtcagcaacaccgcaaccaaggatagttatattaatgtaatatccggtccggttgcagacttcagcttcaatcctgcgtcaccagttaccggagagacggttcagttcattgatgaatctttgggatctccggcatcctggcagtggagctttggtgatgcaacctcttcatcagtgcaaagtcctgctcatgtctattacctgccagggacctataatgtgaccctgaccgtgagtgacaagtacggtgactcgagtatatccaaatcggtaaccgtcactggtaatccgatctccaccggtttagttgctgatttcaccatggctccggcatctgcctatgcaggtgaccagattcagttcaccgataagtcaaccggtggaacaccgacatcctggcaatgggagttcggcgataatacaacctcgtcacttcagagcccggtacacatctatgaaaaaccaggtacataccaggttattctgaatgtaggagacagccggggagttggcgttccaaagatcgttgattacctggttatgaacgatgcaccggttgcagcattctctgcagatccgttatcatccgaattctacccggttcaggtggagttcactgatgaatcaaccggtgttgttgatgaatggaactggcagattctgcgtgaaggaaaggtagttgcaacatcagttgaacagaatccgacgattacatttactgttccgggtatctacacggtaaccctgacggtgaagaataatggtggttccaactccgtcacaaaagacaattatattacaatcggaaccggcagtcagtttacgattgaacagggatggaaccatgtgtcagtccccatggctgtaacagatgactacaacaccgtcagcaaactgtttaagggtatccagaccggaggagttccttatgcagtcttcaataatgctgcaaatgaatgggtgaatgtgactgatgattatccggttaagccacttgaagcgctcagagtatggaaggaggatccaggatcaatcgtgataactccggattacacaaagggaggtatctttacccgtgatctgaagctaggctggaacggtatcggaatcatgttcatgcagccaactcctgctaatgtagcccttgcctcactgggagaagcctggaacaagacgctcatgttcaatccgttaacccagcggtgggagtatccgattatcaggggagtggatgatgacaaattcatgtatccaacagtcggctatctcatcgagatgaacactgacgggatactgattggtggtgagtaagatgagtatggtgatgaaaggaatcggagtctgtctcctgatccttcttcttcttgcaggtatagcgccggcaatggcagaggatgtggagattaagcagctggtcccgatgtttctgaaagggacggtttatatcggagatacacctgcaaaacccggaataacagtggaatctgacatccttggattctggggtggttcggctgtaacaatgtcgaatggaacatacggaacggaatctcagccgatgatggttcaggcaggagcaaacgagacactgaaaggtgaaccggttaccttctggctgaatggagtaaaagctgaagaaacaattctgtatcagccaggtatcaaccttgaccttgacctgcatttctctagtgcagcagagaataagttaaccgtaattcctcagggaggagacgtcttcattggtgaggagggacttgatgtatccctgttcctgaagagtggagatactatcgcctggtttgacccgacttcagaagcatatcttaccgaaccagttggttctattgttatcgacaacccgaagcaattcttcattgacccggcacagttcatgaatcgtactggcagatggtggatctggtccggagataaatccaagcaacttgcatttattgtaaaagatccatccattgctcttcgtatatggaatcagaacgaagaccaggatattaatgaggatggaggaaagattccggcagggaactttgtaaacttccggattgaatcaaatctttactctgcaatcattcagcgaggaaaaggacttgcacctgaagaccttggtatcatcaacatggtcgggtcttccaacgtgactcaggtgacctataaattcctccgtggaaccctcaatggagttccagactcagatattgctcttcgtgaactggtagttgatgcaaatccatggttctggccggataatgataagacaacctccggatggaatactggagcattaggaactgatctaaatcgtttatatccgaatggcgaatacaacttctatgctgaagttgatctgaataatatcagaaagaattatccaggagatcagactggaaaagcaattaccaaggtgattccggcggttattgcagatgactcgatagatgttatcgtcaatccgggaaccgtaacccgtaattcgtccttcttcgtaaccataggaggaagaccgggtaaagactatatcatcgttatcatggaatgtgcaccaggagaagacgatccaaaggattgctgtgctctcaagatgagtggtgcaccctgtgagcgtccaccgatgatccgccccgaccagagtggtgttgcagacggaacaatcgggtttgacagtaaggaaggaccgtttactatcggtgatacaaaactttcaccagattgctgtgagaagagtggtactatccgttcagtcgttccgaccgatgacaagcccaacgcacgggatgtctatgagaatggtgtctactactatgctcaggtcagaactgacaatgataacgagccaactccaggatataagacggtagaatttactgtcggaccggacgttgcacctgaccgtccatatcgtatccatgtgcagagtgtcgagtctgatccatctctggtcattgatggagatgctcttgttcaggtgaacaagggagtagttactcttgatgtgaaagaagagcctccatactatctgggcaatgatatcaccctgtcaggaaccaataccgatagtaatgttgtctacctgttcatgaccggcagccagtgccagaacaagtgtggaaatgacctccttggatggaaacgtccggacgagactgaaaacatcatccagccaggactagatatgattgagcttggctgtaaggaagagtctgatcagttcacaaccattgcagttccggtcaagagcgacggaacatggacctacacctggaagactcagaaggcaccgattaatccgggaacatacaccgtctatgcatccagtcagccgatcaacggatgttgtctggactgtgcttgtgcggtcaccgcatcacgtgatattatccttgaggagccatgctttgatgcaatcctcgagccggatgtcatcaccaaaccggttgagtgctgtccgaatggctgtagctggacctctatggatgagatcatgctgactggaaaggcatgtgggttcccacacaccggtgaaggcgataatgtcactaaggagatcaacatgtggatcttcggagaagagaaagtcggcaatgacaagtatgttaatgcaaagattcctgtcttctgcgatgatacctttgaagtaaacctgctcaactacatcaacctctgtgatctcaaacctggtgcatacagcatcattctgcagcacccgatgtataatcacaagtttgacatggtagaggagaccgatgtccgcgatccaatcgaatccaaccggatctggatggttacctcctatccggatgagtggagcaagctcttcccactcgacggtccgggttactaccagggtgagcaggcagtcactgcaatcaagaacttccttgaccagcggctggtggatgacaaatacatcatcctcaccctcagaattgttgatgaccgggttccaaccgctgcattcagtgcagacccgacccagggaagcagaccgcttgaagtccagtttaaggatgaatcgaccggtaagaacctgactgagcgatactgggagtttggagacggaacaacttcaacagagaccaatccaaagcacagctacagtgaagcaggtgtctacactgtctccctgacggtcatgaacaaggaaggagcaaaagacactgcaacaaagcctgattacattaccgttcgtgaaccacggattaaagcagacttcgttgcaagccccacctcaggggcagcacccctttccgtcaagttctctgacaagtcaaccggatcaccaaccaactggttctgggactttggtgacggattcacctccgcaggagtaaaagatccatcccacgtctaccaatatggtggcaagtacacggttaccctgaccatcacccttggtgatgagatcgaccgggcaatcaagaaagattacatcacagtcatcgggggaccacaaccgaccccgaccatcggaccatatgatccgaccaagattcagctatatagtggctggaacttcatctccgtagcacggacccttgctgatggatacagcaatgcaagtgcggtattccgcgatgttccaaccggtggacatgcaatctgggcatatgatccggcacggcagtactgggatcaggttctgacccagacggttatagcaccattgaatggatactggatctactcggttactccgtttacgattaacctgacattcaagaacgatccaatcagtgctccagttaccagaagccttccaaccggatgggcagcaatcggatttaccggaggtacccctgcaaccgcaaaggacaccctgaaatcagtcaaggatgcatggatttatgcccgtggctatgatgcacagcaccagcagtgggaagcaaccattgtgaacggtggacagggtgagaacacgtatctcttcccatcgaggggatactggctctacatggaaaagcctggaacactggctgccattggtgtgtgaggaatcatgaatacaggaaccgtagccgcccggacggctctggctacactcctcctgttttcctttgtacttatctgttctgccggggctccggcacttccctgtgagttctacggaactgtaaccattgacggctcccctgcaccggcagggactattctgtcagccaagatcaatgatgcggaacgtggccggtatgtcctcgaggaagcaggaacgtatggaggaccggggacgtttgaccagcggctgaaagtagttgctgaagaaggtgatctttcatccggaagtgcgcagatcaccttctggatagacggacagaaagcatggcaggagaccgcattccaacccggagtcagcatgaaactggatctctcggttggtggtgatgcaccggcagtgacgaatgttccatcatcggataccctcgtgcatactgtgcccgaaactggaactgaaactaataccattattcaggaaataccggtagaagctgaaatcacagaagaacctatccctgaacagcaggttcagactgatattcaaccggttatcagtgacatgccaccgcagctccctgaaatggaaaacccggttccggttactgattctccggctgatgttctgattgcagactttgtaggagaaccggtatccggaattgtcccgttaaccgtgaccttcacagatctctcaaccggaggaccaaccatgtgggcatgggactttggtgatggcacaacggatacggtcgcaaatccggttcaccagtacatgctcccaggatcctacacggtcagactaacggtctcaaatcaggattcaagtgcaactcagctcaaggaagggtatatcacggtatctgactcaggaactcttcatgcagactttactgcacagccgacatccggaaaaccgcctcttacggtgaagtttaccgatacatcctccggcagtcccacgatgtatgcatggacatttggtgacggaaccggagacatggtcgcaaatccgactcatacctacacgagtcccggaaaatataccgtcaacctgacaattgccgatgcaaccggtatgagttcaactgctgcacgaaaagacctgattcaggtagaaggagcggttactcctgtcccaactctgacacccatcccggtgccggctgttccccagacctttgtcggaacggttgagatctatggaaaaccaattcagagtgggggaacagtagaggcacggatacccggatatgacatatccggacagttcaatccgatcaaaacagcaaaaggagtattcggaaaaacaggaaccttctctccaaaattacaggtacaaggagttcctgcagattcagaaatagaattctgggttgctgatgagatgacccggatggttcgggcatacatcctgcaggatgatgggacttatctctggaccgttccctatcagccgggtaaagagacacaactcagactcgttgttctgaaaaacccgccaaatgaaattccaccaattccggtaactccggtaccgaccggctgtgctggagttccatccatcccgatgagtattcagggtgatgtcaggataactgatggtactgaatatctggatgcagatgggacctgttacaactgtcagccaaatatcaagatcggtggcatgattgaggccaggattgagggacatgatgtttcaggacctgagaatcccttcaccatggtcagcaccggctatttcgggagtggaaacagcagctgggcagataaactcaccattcagggaaaatgtctcccggagaattccaatatcaccttctgggtcaaggatgacggatggccacggtatacccaggcatgggtgatcaatgaggccatcgatgacaacgagaccatcagtgtccttggagagaccagggagatcccatatgaagggggaatttcacggactgttcacctctgggccggaccattaccaaccgttccaccaacaccgactccgacacctgcaccttcagcatgggagccacagtacttctatggaaaagcagagttcaatgggtacccactcagagttggcgatcgggtaatggcaaccagagaagggatcgatctctccaatccgacaaatccggtttcagtcctgaaatttggagagtatggagatcttgtcggaaaggagatgctcgccgttgacgttccgtatgaatcaatggagcagcgtgatccgatcaccttctggattaagccccaggactttgagtattggtataaagcggaggtaaagaaccccttgtccagtgcagactggagtgatacctatccgtttaccccaggttcaataaccaatcttgatctcagatcaaatgaccgggcagatttcatgtacttctacgatattgtagaaaccataagcaacgtaatcctgccggatgattacaccggctggtaaaattaggtgaaattttcaccattttttatgatactatgacaatcaagtgtaccatctggatgccggttcttctcattgccggcatgtgtatcgctgtatgcggactggtatccgctgcatcaccccagcttccgtgtgaattttatggaactgctacaatcgggggctccccggttccggctggaacggtcattactgcatacgtgaacggaaccccgcaaggaaggatcactgtaaccgaagcaggcaaatttggtggaaccggaacatttgatgaacggctcattgttatggccggggaaaaagattttgcaaacggggttccgaccataacgttcaagatcaatgaacagaatgccgatcagtctgcaccataccagccaggagcaagtacccagctgaatctttccgtcgctggacaggcagcagttcctgcgccggtagagccagtcacacaatcaaataattcaactcaggtgccggtcattgtagcccaggttccggtccaggtacagactcctgcaccaactccggttataacaccggtgcagaaccaaagttcacaggctgttcagccggcatgtgtctctgctcctgctcagtaatccctatttcttcatttttattttttttatatcgatatcattttgaatatgataatcaaatgagaaagagtattgatcatatgacctttcagagtgaccgcgttcaaatacggaaaatatttgccgattataagattccacctgacgagcagaacgatataatcaatttattgcatgatttatcaaaaaattgtcagatacttgcgatatatttgtttggatcttatgctcgtaatgaaccaaaaccatattctgacattgatatagcagttattacccggatgacagatcctccacgagatctgaaagagataattggatcttattcctcaaaaaaactcgacgttcaggtttttgctgacctccccctttcagcacagatgcaggttttggctcagggagttcctttgtatatcagaaatgaggattctttatggtcagttattaaatcagtaagtctgtcctttatggatcttgaaccaatgagaaaccggtgtagagaacgattattaggtgtgtaatggatctccaaacaagagttctcacgataatttcagatattgataggttttttcgtgattatgaaaaaatcacttcggaaggtgcgatacaggatgctgatacaacacgatttcatgcaatatcgatggttctatttacgatattgaacctctcttttgaacttggagaagaggttatcgggtatcggcatgctggtctaccgagcacgtatcgggatatttttcggatactctgggaagaaaagctaattgatgagaatattcgtgaaaaaatgtctcacatggtatattatcggaaccgtcttgctcatcaatatgctgggttaaaccgagaagatatcgatgcaataatctctaatatcgatgttattaaaaattatatccaaaaaatgaaggtcgctttaaaggaagtatcatcttgttagtcagatgtgtgatctgtaacacatttttctatatatttttgtgttttcttatcacattattcattatgtagtccgtgattatttaagcaattatccttatgtatctgtgaggtctattagtaaataaagagcatatcatggagagattagtactacaaaatcttcattcatggcgaaataagaaaaaccgtctcccattaattctgaaaggggcacggcaggttggagaaacgtggcttttgaaagaatttggaaggaccggttttaaggactatctttatataaattttgaaaataatccttcgatgtcagatttatttgaaggttccattgatccccatagaattctcgaattagttggagcacttcacgggaaaaaataactcccggagatactctcctgatatttgaagaaattcaggaagtgccacgagccctgacatctctaaaatattttgcagaagaagcacctgagtattcaatctgttcggcaggatctttacttgggatagcacttcatgaaggcacattattaaccgtcgggaaagtggatattctaacacttgagccccttacattccaagagtttcttctagccaatgatgaatatgaattactcttatctcttcaaaattccggattggagcctctgcccttactccttctggagaaactacacgattatctgaaaaagtattatatcattggagggatgccagcagcagtgaatatctggattgaacagcgtgacttttcccaagttgaaataaagttaaaaaatattttagaaacgtaccaacaagatttctcgaaacatgctcctcgttcgatggtcccaaaactcaggtttatttggaatagtattccttcacaacttacacggaagaataaaaaattcctttatggactggtaaagagtggtgccagagctcgtgaatacgaagatgcgttattatggctattggattgtgggcttatcagacgggttgggagaatcacgaagggagccatacccatgaaaccggatgaagatctccatgattttaagatatatcatcttgatgtcggtttgctccgggtcatgagtcaacttccatttcaggtgattcttgaacgaaataaggtttttgaggagtttaatggggcattaactgagcagtatgttctccagcaactttcatcgataataaccggttcaatttactattggacatcagaagcgacagctggagtggattttgtcatctcaaatgggactggtgtaatacctgttgaagtaaaagccggagtgaatgttaaagctaagagcctcagggtgtatattgacaggtatcagccggagatttccattcggacttccctttcaaacgtgcatcgtgatggatccctcttaaatatccctctctccatggtttttcacctggaacagtacctcgaactctgcaaaaatcctgatacataattgaatcaaaacttggaacccagccacctcttaggatatggtgcgtaagctagggattacgatgaacttttatgagatctgcccttctccctgcatccttcctgtggtaccatgagctcaaatctggccccttctatatgacggctcgttgtgtccatcaggttttcaagaatcgtttcaattattgggccagtcattaattcaaaaaattgtggaatgaacttatctggcaagttctgccatgaatgcataatcggaattaaacggagttaattcaaatactctgtaaattcttcgagggtgagagtttcaggcttaaagaacccagcatcttcaagcaatttaggtactcgatatttaataagatttttatctgatgttaaaaaataggtacaaccattcgacatagcgtatcctatatgcacacgatctgttttttccacccggaaatctatctcacggttggccatacaattgcagatacgtgccacaacttgatcagggtaaagggtggcaacattccattcttcgcatagattgataaaggaaaggatgagctccgatctaactggacgctttctcatctgatccactgcctcccccataacgggtattgaggtaaccagagagaatccaagatgaattgcatggctgattatggtctttttcctcgaatcctcaatgcattcaaaaaagatgcaggtatcgaggaaaacagatttcaacaaacccctgccttatctaaccgctgcatcttttcatcgaattcttctttcgtaacaacaaaggcgatgagcccacccctaccaacacctcctccatatggcagcatacctcgctgatatggcttaccaacattctcccgtgggtccccctcatattccataaatattattaggcggaatacaaggatgaatgtttcttcaaggggggtctgaagtattagatgtggcctgtttactacattgaactataaaactccgtaatgcaaataatcttattggaatatgttcgatattccttactgattgcgtatggagattggaattatcaaaataagttcaatggggtagattgtgttcctagtatcgatgagatgagatctctatgatggtttacatcgtattaaaatccggaatgaaagtggttttccgtgaaaccgtttgaagatccagaacaggcaataaaggatgatatacggtttgccgatcggacagaaaaagcatatcttgagtttgagctgggagaatataatctcgaaaatgatttggatttcattcaaaatatgaaatcatggtaattatgtatgtccaaaccgcatatctccacttcctttagtttaataccctcccttctaaaaactcttcgattatccctgctatctcttcaggttctacaaagatcatcccatgcccctgtcctttcctgataatgagcgttgcattcgggatggcatcggcgatgatcacggcattttccgggggaataacaagatcctgatccccggtgatgacaagtgtgctgcaatggatcgaagggagatcagcatacacacccttccacgagaggaaggattcgtactgttcctgtactgccgcaggatcagcgacctccccgtaatccacaaaccaggtatacgggtcagggtgactggtgcggaattcatcagtaaggagaagtcttcctgcccgttccagatattctttcggattgttaagtgtttgtcccatctcttctatcaaccaaggttcagcaggcactttttcagcaccaccgcaatcggtactgataagaacaaggtggtttactgaatcgggatatgttttcgcatattcaagagcgatcataccgcccatcgagtatccgacgatatcaaccgggagagcagtaccattccctttctctagagtcctcgtttcatcggaattcaatccatcgtcagaacttccacactcttttttccctcctgccagttgagtaataacatcatgcagatccatggctccctgcggaatggtaaatggaacatacgggttatggacccccgatattccgcgatggttgtagacgatgacggtgtggtttcgtgcaagattcgatattatccggtgcggccattcatcgatggtcatcccatatcccaggacaaagaaaacagggggaccttctccatgaatagcatatcgaagaggaataccgtcactggtgagaataaatgatgaattcttctcttctatactgctatttttctgatccgctttatcttttaccccagatgactgtgctttgttgttatcaatacaaccagacatactgattaagatgacgcatgccgcaatgaaaatgatttcatgagagttgtgtgtatggtgagttatcaatcatatgaattacttattggttcttctcaatggcaaacaaggatattaaaattttcaaaagagaggttatacctgttcaacccttcagatgattctcctctgaaagagcaaaaaatccagaaaaaatttcggatttttaccggagtttccctttaatgggatactggacattgtcattactgacttttccccgaacattcaccgttacattccaaagtccaggtctgcatgattcaggtatactaaatgtcccggttagagtcccttttactaattcacctatagcggtgatgttcttctcacctgagtgtgacaggtttacaatcgccccgttctcaaaattttctccataaacaacaaatccgctcccttttcctggtgctgcaaatgacatggcaatggagcgtacgaccgggaacggcccggatggcagaacgatgaactgaacattatcattactggtaaggccgctttggttcacggtcacattccatggtccgggcagagcatcatcggggatagcgatggtccctgtcaggtttccttctgagagatttccagttgatgaaatattgacctgttctggatgggagaggtttaccagagcaccatccgtaaggttttctccctgaagaaggtaatcggttgattcaccctgcattcctgaatcaggggtaatattatgaacaaccgggatatgaaccggaccatctgtgatggtgaactgaatctcatcgttactatagagtccgttctggttcaccgatgcattccatggtccggtgagagcatccgttggtatcacgaatgtgccaaagagctgtgatcccataagatatccgattgacgtaatattttcctcaccttcatgggtaaggtttactattgcgccattcagcaggtgctcacctgtgattgaatagataatttccgtacctttctctcctgagtccggatttatcgaggttattaccggggtatctgccggagccggagtaatggtgaataagatattatcattactgaataactcgtcctgctcgacgatgacattccatggccccgttatggcatccaaaggaaggttgaatattccggtcagttttccttccttgagtgttcctgttgaagtaatattggtctgcccttcttttaccagatggacgaacgcaccatcaacgaaattggagccggtgacagtatagttaatggtcaatccggcctgaccggattctggtataatacctgtcacaacagggaccggaatcggtgtaggtgtcggagttagagttggagtgggtgtaggtgtcggtgttagagttggggtgggtgtaggtgtcggagttagagttggagtgggtgtaggagtcggtgttagagttggagtgggtgtaggtgtcggtgttagagttggggtgggtgtaggtgtcggtgttagagttggggtgggtgtaggtgtcggtgttagagttggggtgggtgtaggtgtcggagttagagttggagtgggtgtaggagtcggtgttagagttggagtgggtgtaggtgtcggtgttagagttggggtgggtgtaggtgtcggtgttagagttggggtgggtgtaggtgtcggtgttagagttggggtgggtgtaggagtcggaccggatcccccataaatccacttaattcctgcaatttctgaagcagataatgtttttaaatttgtattaccaataacgtcaccattatatccaaacatgaccttcatgattgggcttaaatctgaaggaaatcctggaacccaaccgtataaatcttttaaatttagccaatgtcccagttcatgaatggctattgcttcaatatttttcaatccaccagatgctgtatcagtagtccaggaataataggtattaaattcaacatctgcttcagatataatgccagatgaaaaccaatatgttgcctgagcaatagggccagaactacctaagtctctaaaaagaagcacatttttaccatcagcacctgattttgtagttgaagatgtaccagcataattaaacttgaatgatgactgaccattccatgaatttgccgcattttgaatggccgtaagtgacccaattatactaccgggattgatataataatttactgaagttacgggccattttctcttcccatatgaaaaagtaactgaaaaatctgcaacgttagaaacttcaccattatccgtcaggattccaacatatccacttgatgctccaccatcataattatcttgagtccttccaacaggaaccttaactcgaatttgagaatcagtccatgagacaatatcatattcatttattgaaaagtgaggaaatccagaagcccatattagtgtttggtcttgtccattaaatctataaagaaagaaaacgtccgcatttgagtctctacttgatttagttccaaaaccagttccttttatagtaataatagtatctgttcctgcagaagcagtagaaggagtgacactttgtatcattggtgaagaagtctcaagtttttttttctcctcatatccagatttaacaaagagtttttttgacgaaattatatgttctctaccttgaattgcttcttcaataattaatttgaattcgtcaatagaatatcttccatattcgttatgctcttcagaatcaactttattattttgtatagagaaaactccctggaaattaccagtcacagtacaaatttcatctgacatattgttggttaaatactgattttttaatggataattcagtaaaagaccgacatcagaaccaattgaaaaggatggttcatcttccacccattgcgtaatttcattaacagttccacctttagaaagtattttaatttcttctttaggaattgctggtccaagaaaaacctcattaacaataattgtcgttattgtgtatatattcagtttttcatcatcccaattactttcaatatctttaacagtcccagtgacgacaagatctgattctttaaccaggtctggaaccgtttttttatccattactccaactgttattcccgtaataaaaaaaaggataaaaattaattgtaatattcttatcccataaatattaaatctcttatcggtttttcccattatacccatcccttttaatcctcaatttctatattgatttcggaatagatattaattttgatatggaacacaatattatcaaaggtttttttatcaatagtagtaatataatattgatctaacactattgtaattttgacaatgcattagtttttttgcttaattgacatataaaatggtagaggaatcagtactactatattcttgttatgagcattattataaatacatttttttaaatagaagagagaattcaaacacccttgaacctaactattactattgaacttatttgaaaaattttcacaaaatatcctgatttacaatattggtattttctccggttgtcctgatgataaaaaccatgattctgtcaatgtcagtgtaaaaatctcctcatctgaagttatgaattacttacttcaataaaaaaatctcgaaataatattgccctattgtgtgagtgatcgttcagataaaaattatttatcaacaaataaaaatcagtatctccaaataacctgaaatcggtttaacacaaatttaaccggggtgctggaattaacagtatacactcacaaaattatgatcttgcttttaaagaggcgcttactctttttgaaaacaaaacgcttgacttcctcggcctggatcttccaaaaatcaccggagtactggtcactgaatttgccgaagttgagacccgtgatgagtttgttgatcttacgttcaggcttgaaaacggggatatactccacattgaggaacaggctaccctgacggaggatgacctgatcagatttgcccattatgacttgagactattctcaaaatatcgtgtatctatccatacggttgtcctttcccctgccaattcaaaaaaccatgtatctgccattgataccggctgccttcattattcggttattcaccaggttatcaagggaagaaatgccgatgaggttcttgagaggatgcatgatgacattgcaattggaaatccggtaaacgaactggaactgatctttgtgcctctcatggagagcaggcttccggtcagggagctgcttcttgagacgataaaacttgagaaagagataagggatgagaacctcaagaataaagtaattgctttgaccatggtgatggcaaacagacttgtggaggctgaactcttagaaaaaatatgggaggaggtaaaaatgttaaagatattaaaatatgcagaagataaaggaaaagaacagggcattcagataggcattgagaagggttttgaaattgggagattggatgagaaacgtcacctgattgaacgactgcttataaagaaatttggtccccttccgaaagatacacaaagtaagattcagaatatggatgatgtcgtccttgatatcctgagtttagagattctggattttcagaccaaagatgatctgttccggtttgtggataagatggcgccctgattcaatggctctttccggtagagggctttgaaccaggggataactcaaatataattttggaaagatctctctcaaataattatataaaactcggtgaaaataacctgataattctcttcaagcccagtataaaaaaaagacacaatatttaatccaaagatattggccgctaattaaaaaactatcaatttagagacaataatgattatttccaaatcatttggttctgctctgaattatcatatgatttagaattttttcggcttaaacccatcctggtttacaatactggcactattgccggttgcccggatcacaaaaaacccattcttctctgcctgcctgaccacattactatctgaatgaatatatgccattgctccgtaggtggtattctctgcatatcgtggaagccattcacgaaacttttccattttataagcaaactcctttacatcagaggaccgaagagttgttttaacttcaacgacaaccatctcgtctccgttctgggcaatgatatcaaattcgtagtttgtctttcctgaatagtctttcagccgctggaaagtatagaaaacagagataccttgttcctgtaagagtcttataagataaccttcagccagaagatcaacaagtctttcccagggagagaagagttgctcttctactcgtgtaatcagttgtgatgttttctctatttgtgcggtaactctgtcctgaccttttctcatttcaatatcttcaatttctgacggttcacgcctttcttggagatggtcaggtacctgaattcttaaaccgttatggagtgacatgaattgttctttttgaaagaccaatgcatcaggagtagatgaatatggagtacggtttgatagatctgaaaaagggatttactcgatatcctgatagtaatactcacctttgctcttctgttcccggtccagatatgaatcaggcttgtttatccgtggtctgccactcatatcccttctgaatgtcaccccaagctgggagaggaacatattcatcccggttctcatatcaaacggcccttttgcctctccacggactccgggatctccgtcaaagaccagcagtcgttcactgatgatatcaattacataaatatcatgatcgatcacaaggattgctgcctcctttccttcgacctggtttctgaatattttggtcagtctgacccgctgctctacgtcaagatgggcactcggctcatcaagcacgtacaggtcagcgggctgggagagacaggcagctattgcgacacgttgcagttctcccccggagagggtattgaccggaagctggagaatcgggcccagagtcagaccttcaacaatatcgtgctgatactgggcagaatcgaaggtacgtgcaatctgcctgaggaagaactcgacagtatctgatgaatcccctttcaggtactgcggtttataagatatcctgactgatgtttccatcgagcctgaatccggtttttcaacaccggccagaagttttgcaaaggtggactttccaataccgttctgtcccacaaccccaatgacttcacccgcaaatatctcccctggatgcaccgtcagggagaacctgtcaaaggttcgtttcatctccggaataacaagaagtggttcccgctgtgatccgtccttgtgtgctctgacttcaaaggtcacctggtaatcacggaatcttacattctcttcaggcaggaatccgtccaggtactgattaatacctatccgaactcctttcggacgagtgatgataccaaaaacggccggttttccatatgcaatatgaaccgtgtcggccagcatatcaaggatggcgatatcatgttcgataagaaccaccggcttttcggtagcgagatcacgtattgctgaagcggctgccatccgctggtagatatcaaggtacggggtgacttcatcaaggaagtaaaagtcggcgtttcgtgcaagtgctgcagcaagagcaacccgttggagttctccaccggagaggttcgaaatctcctggtcaaggatctgacgaagtgagaggatgtccaggtactgatcaagcgctccacgctcatcggttgttttcaggagatcccagacctttccctgaaagaccttggggatgacatcaatgtactgaggtttgacggatgccttgattgaaccctttgaaagtcgctgcaggtaatcaaagagttcggtaccggtgtatttcttgagaacttcttcccatttcacttcagtgtcaaagatcccaaggttcggactgatctgtccggagaggatcttcatggaggtggattttccgataccgttggctccgattacaccggtcaccttcccttctataggtgcagggagaccatacaggacaaagctgtttggtccgtaccggtgtgtcggatgttccagttcctcaggcagagtgatgatatcgatcgcttcaaaggggcactttttcacacagataccacacccgacgcagagttcttcagagataactgcttttccttcttcatcaagaaggactgtttcgtctccggtgcggactcgtggacagtacaggatacattccgtcccgcatttgcgtgaatgacagagatctttatgaacgacagctattcgcatgggctatcaggttgatatggtggtctcggagagcaggatggtccaggtgacataccagaaggcaaaagtgataaaaccctggtagaaccagtctttcttctcaagtttggtcgtgtctatccggataagcatgaaaatgtgtttctgaatgattattgaggcgatcatcaccaggataggaaagataaaagatttccctgcccctgatgttgcggtggcctgttcggtcagaaaacaaatgattccggcgatgcacccggcacctacggcaatgagggtgcgcgtgatacgcttcgtatattctgccgtttcatcaacggggagaggtgcgtgtgtttcttctgctggagtaatcgtgaccggttcttctgtcattggggcaccagttgtcttatttttttagtcatgaggccatatgtaatttggtatcatggcgacgatgcaggggatgagtggacttgacctcatcaccgtaacagacgagatcacacggctcctccccctctgggtgcataaagtgtacttagatgagaaccgtctctgtatcttcagactgaatagtaaaaaccagggaaaggtaaatatccttattgaaccaggaaggcggttccattgtgtatcaacacttcccgagatgccacagatccccccggcatttgcgatgtttctcagaaaatatcttgccggcgggagggttgacggtatacgtcagcaggggttgcagcggacagtcataatcgatatcagaaagtccgagcagctgttccatctcattgttgaggtctttgatgatggaaatatcattctgtgcggggaggatatgaccatcatccagccgctcacccggcaccggtttaaggatcgtgatgtactccccggggctgtatatgtctttggacagccggatgtcagttccatacccgtagaggagtttgctgagcggttgtccaccgatgaccgggatattgtcaggtccctggccgtcggttcattccttggtggtcggtatgcagaatacatcctctctgttaccgggatagataaaaaaacgcttgcaaaagaggctgatgctccggcactttatactgcgatccataacctccttgaaaaagccagaacttctccgaccccggtccttgataaaaacggatgtcatccgattcctgtcggtgatgaaaaacccggttcttttgactcctttaatgcggcccttgctgcattctacccggttgcacctccggtaaagaaacaggaggagaagatacgggtatcccgtgaggaccggatccgtcatcagcaggaagaggctattgtaaagtttgagaagaatatcacccggaatgaggagcttgccgctctcctctatgaagagtacggctttgtatctgaaattattacaacactatcaaaggctgcagagactcgttcatggcaggaaattgaagccatattaaagaaggatacgagcggtgcaggaaagaaaataatcaggatattccctgcagaggcagcagttgaactcgaccttggtcgtccggtgaaggtttttgtccacgaaaccattgaccagaatgccggcaggtactatgatcaggtcaaaaagttcaagaagaaacttgccggggcaaaagcggctatggaacgtgaggtgcagcaggcacgaaccaggaaagtgcaataccagcggccgaagaagcggtggtttgaccggttcagatggttttatacatcagatcaggttctggtcattggcggccgggatgccgggcagaatgaagaactgatcaggaagtacttggagggtggtgacacctttgtccatgctgatgttcatggagccagtgtggttgtagtaaagggaaaaacgaaagatatggatgaggtggcacggtttgcagcggcatattcaggtgcatggcgggccgggtttgcatccgctgatgtgtatgcggcacggcctgatcaggtatcaaagactgcagagtcaggtgaatacctctccagaggttcgttcgtggtcaggggagaacgacaatggttccacgatgtcccgcttgaggtagttatcggccttcagaaggccccccagacccggattctcggaggtccggcatcagcggttacaaaatcctgtgaccttttcgtgacccttcgtccgggaacatttgagcccaatgatatcgcaaaaaaggttgttcgtgctcttcgtgagaaactatctgcagatgaacagaaggcacttaaatttgcgctcaataccgaagcggtcgctgcttttgtcccgcccggaggatctgatctggtggaaggatgaaagcagaaatagaggaactccaacgttcatttggtgaaattcgtctttttcctgagaatagtgatgacctctggcacctccacaacctcattacacccggctctctcgtctatgcaaccacgctccggagtgttgaaggatcgcaggataagatacgtccggaaaagcaggaaaagcgaccggtccgtcttggtatcagggtggaggatgtcgagtttcatgaatattcaatacggcttcgggtttttggaaccattgaatcaggggtggatatcggctctcatcacaccttaaacctcgaacccggatatgagatctcggttatcaaatcatggtcaggaagtgatcttgaacggattgatcgggcgataaaagggtcgacatcagaggcgattcatattcttaccgttgaggagggggaagcagaactctaccgggtgcagagttatggtccaaagcaggtctggtcacttgctgctggaagcgggaagacagcggaggtgagcagcagggaagagttttcagaggctgttgtgtcacaggtgtcacagctcaccggaccactggtcattgcaggacctgggtttgtaaaagaagagattatcgcgaaattcaagcggaaaaatccttcccgttctgcacccctggtcattggggatacccgggccggaggaagaagggcggtgcaggaggtcatcggccagggtatccttgaaaaactgaacggggatctgcagctggcacgggaagtaacctgccttgatgaacttatgcggcggattggtaaagatgagccggtagcgtatggaatcgatgcggtcagggatgcaaccggatgtggagcggttcagaccctcatggtggtggatacccttcttcgggatcctgatgcagcagatcttatcagacaagcagaggcgatgcgttctgaagtagtcatcttctcttcacggtttgaacctggtgagcgacttgccggtcttggtgggatagcagcccttctcaggtattcaatagcctgaaagccggattatatcatgtatctggttcggataccaaatcctgattgtgtgttttttcatgataatctgtcagaataaaccgattgatgtttaaatgcgggatcgctaatatacattatgcgtaatctggtgactggtacacaagaccaggatcgctgggtagtactgatcctttccattaccgtactggttttttttatctcctggtacgcaagagggtgttgcaccaatgatcaatatcatgcaggatcacaaatgatcgatctctaccccttaagctatcaaccaaaatagactaattgatgtatgaacctgcatgtatcaattcccactttacatactgtgtttgcaaaaatataggaaaaacctgaacctcttgacggttttataatattcgtagcaaattctttaattttaactataccctcaaatctgataagtttttttatattatgcactaatgcagctaaaaagaattctccctcgcaattctctttccctttttgagagaaactcctaaacctcatattatgtttcatattaccaaaaactggttcgaccatgtattttcgttttcgatataactctctaccagtgggggatttcacacgtacttccataactcgtttacaaatttcctgagttgttgcttgtttctctctgttcataaaagattgccaaacaaacgtcccgatactttgcaattccggaaatgtgattatttctcccatacaaatcgcccgacatatcatttccattcgtgagatatacccatcattatctgaatattctggaatttttctttctttagaaggagggatgatgagttgaatgccataatccaattctgctaaagaattcgggtatgagaaataacctgcatcagatagtagtatattaggcgaaattgatggatgaatacccgtaaaaaggtcttcgagttcatttagcataggtattaataattttttatcgttttgctcatctgatatcattgcagcgaggataaattgattttcagaaacgataatctgcccattatacccttgaatccagccattggtggttgacattatctgactttcaggatcagtgagatttacttttgaatctgaagatggctcttttttaggctctaaaggctttctacctcgtttctttttacccgattctaattcttctttttcgcggtccagaatcttttcttcttgttttttagattcgatatcatgtcgttcaattaatttctctttagcccgattaagaacttcctttcgtttttcttttgttgaaagatgctcaggtagtcggttaatctccatatcctgaatatttatatcatcgttttctaactcatcaatttcctgtgattcatcaaaaagccgacctagctctgcttcaaggtattttaattttttattggctgataaagaggcattacagccaaattttgatccatcgagggctaggacaccgattcttgctatcccggattctacgataatttgagataattgtttaaaaagggatttgatttcttttgaattattcttcttgaaacgatagatcgttgtatggtcaggtgtaagattattggcgacgatccgatatccaatatcataatggcagcacatctcaatttttctgctagatttttctccacgaatcattgaataaattattattccaagcattgaacgaggatcaaaaaaggcagaaccgcgaccatcgtcacgatatttattaataaatggactaatatcgagaatcgaaagaatttctaatatgccataagtaatatcattttcagatagccagtccatcgcattgacagggagtaaaaattgttgttcattaccatatcctctaatcatgttatagcgatgagacatataatatattgatcttaataatatatataattaagctttaataatttatattaagctttttttgtgtttgtgcaacagcctcgcaatatcacacaatattcacactgtcatatctcatcttttctatattccggttattcttgcctgctggaggtttccaaaacctggaattatctttacgtttggtctgatctggggatatatcggccttgaatactttagtcattacgtaatgctcgatcctgacgtcattctccggtgccttattatcatctttatcgggattgtcgttgccctgctttctctaaacctccatgaccgggaagagtcttaccgtcggctcctttccgccattgatgccggggtgattaagaccgaccggaccggcaagattgtttatgcaaatccatatgctgtgaatgtactggatcgaaaggcagtatctttacatgggacatcgcttcatgagtatgctatagatggtcctgagcttggcggttttcttgagcaatgcctgaaaaacggtcattctgatacgacccgggaactggttctgaaacgaaaagacggatttccaataccagtagtactgaccgggtactcgcagaaaggtgaagatatcattcttacgttgaccgatctctctgaagaaaaatggatggctcatgagctcgcaacaggccggatggttatgacgacgctcattgatgccatccctgagggcatctttttatccgacaccagggggagcatcatcgaggtgaacaaatcatgcagggatctgaccggctggagtgaaggaactgatctcttcgaggaagcaaccggattcttttcaccggacgcatccgaaaagatacggcgtgcaatctatcagacaatccatgagaaaaagtccgtcactcttcatcttgaggtggccccggatgacaatacgcggcattatgaggtttctctgaccccggttccagatgatacaaagactattacccggattgccggtgttattcatgacattaccacccgtgaaaactatctgaagcagatccgggagcgggaagaatatcttcgtatggtcctggatggcctgcccttggcgactctggttattggcccggaccataaggttctctcggtcaaccaggcacttgctatgctctttgagcgtgaggtgaatgacctcatcgggacaagtgagcacggtcatctcctgtatccggcaggggagcgtccgatgctctgtgatctgatggtcggggatgaggtcgatgtactccttgatgagtggtattcagatctctattcaccatcaccaaccgttcccggggcttatgaagtcattgatttcttcccgcatatcggtgaagcagggaaatggatcatgagcacatcagcacggctcgtcaatgaaaagggagatactatcggggcaatagagacctttgaggacttttcaactcagaaagcagcggaagaagcaatacgaatcagtgaggaacggtttaagatagcatcccatattgccaccgaccttatatttgagtacgatcagaagtcagaccagatattatggtttggtgatattgagaaatggctgggtctggactcccctgcaagggtcagtaccctgaccggatggacgacactgattcatgaagaagatatcgggaaggtaaaaggtgcctttatccaccatgtactgaccggagatcccatcaccgaagaactgcggatcaagcaccggaacggccagtttcagacatggataatcaaggcggttgccctgtacaatgccaatttccagcagattaagaccgtaggtattgtttcagacatcagtgagatacgagccaacgaggaggcaaagaaggaagctctcatagctattgagaaatatattgagcagtttgcaatcctcaatgatcatatcagaaatcccctgcagattattgccggatataatgatctgcagggtggagaatatgctcatcacatcgcatcccagatagcccaggtcaaccggatcgtcgatcagcttgataaagggtggatagaatcggagagtatcagggattttctccgccgccattatggcatctctataaaagactctcaaaaatagttggcccctttatgggaactcaagggtaagggtcaccgggcagtgatctgagcccatgatatcatttctgattcctgcaccggtaatgaatggttttgccgcagtattgacgaagaaataatctattctccagccgacattccgtgtccgtgccctgctcttatagtcccaccagctgtactggttcccttcatcagaaaacagcctgaaactgtcataaaatccggcagcgataacccggtcaatccactcccgctctatgggaagaaaccctgataccagttcattctctttgggccgtgcaaggtcgatgggtttatgggcggtattgacgtcaccacagaagatgatacgctctccggcggcatccatggtcttgattttctctaaaaatgcatcatagaatctgagtttgaatgcaagtcgttcatcagatgctccgccgttcgggaagtagacattcatcagaacaaactcagggaaccgggcggtaataattcgaccttcagaatcaaactcgggagatagccctcccagttctattgattccggctcggtcctggagtacatcgcaaccccgctgtatcctttccgttcagcaggattgatgtagaagaaataatcagggatacgggtgatatcaggctttaatgaatgggcatctgcctttgtctcctgtatacagaggatgtctatattctcatgggccggcagtccggggaacagaactccggggagtacctctttactacttatagccctgagaccattcacattccaggaatagagggtgtatgttttcattatattacccgattccaaaccgtcgtagcgcaataaggctgttatgagctgccctgaatgtcggggcatctatcacccctctcgcaccgtttgcaaacatgcttgtcgctacctgttcaaagtgaatggaacccctgccaatctcaagatgctcttcggaaaactccctgcagtcatacaggtacaggcaccggctggctgcttcatggagaaatcgtgggaggcatccgttcacatgggcatgtccgatatcaagggccagagggacctgggtgatgagatttaggtcttcaggatatctgaccatgtttccttcccgtcttcccatattcctgaataaaaaccgaataccgaattcatcagcagctcgtatgatatccacacaggatcgggccagttgccgtttcgcatgggctttgtctgccggtgatgtaacaaaccctggatcaacgacaacttctgctccaatctctgaagcaaactcaaacctctcggtgatgacagccaccgctgcctgcctgatcggttcatgtatacttgccggattaatatcccgctgtggcagtcgtatcatgtatttatacggaaatgattcaagaagactgacggccgggatgcgatgaacaccgccgtcaacaatctcaatgccccgtgtcagggaaccaagactttcaagggcgatgtcaagcggtgtctcccgcatacaggtggttgaaatccagagcatggtatcatcagggcttgttgtgccgttctgttgtaatatatggaataggatccttttatagtactcaattctggttcattcaggaaagatcgttatccttttattcgtgacctatcgtacctaagaccatatggcattgtccaaagattctacaatccttgaagtactgcaggaaaaacctgatgcaggtgcgatatttgcccggtttgggatgggctgtgtcggttgtgctatcagcaggggagagaccgttgcagaagcagcagcagcacatgggattccactcgaagagctgatgtccgctcttggaatctccgcataattcctttttaaataactttcaaacgaaaaaagattagagatatccgaatgactttaaggtaacatccggatttacttcaccgacatggtacacctttccttcggtcagttcgttaatggtaacttctgccggagagaagagtgacgtgtcgatctggtaaaaatcaaagtttgcttccttgaagatttcgtagaacggctttccatatccttttgatttgttgcttggtatcttctcaagaaagtcgacaatatcgggggctttcatggtaaggcttatctgaccatgatagatggtagcgtcattggtcgttcccatggccttggttgcatcagccttcaccggcgggatcggagctgttcccattgctgctgttatctttctcgtatcaaacccgagttcattcagtttgtatacggcggtctcaacacaccgaccacagacctgaatggatccaaccagtgatgcggttggtgcgacgacggcacagaggttctcgacatcaatgccacagtcctttgcgatcttctccataacttcgccattgggcaggtggtcagactcaagggcaatgactgcgtcgtcactctcgtcttcgtacccgatgacttcgtaggtgtgttttggtttcagggcaagtgcacgtgccgggcctgatcccatggcaaaataattacctgccttaacggtccatcctgccttttgtgcaccaagacatgagattgccgggtagtcggtggagacctcaatgaatggcatgggaacatgctttatctgacccattctgaaattaacctcaccaagaccccccatacagatctcggtaaaagcccgtcctgctgcatatccgccaggaactgacacaccacagtcaactatctttgcgccgttgtcaagttcatggtatgcgacattgaaatcttctgaatagttagcaagattatcgaatatctcaagtgctaattcattaacgctaatcatgttcgaacccccgtggagtaccattacatctctgatgctgcggtattgaactcttcgttttagcccttcgggggatttttatagatagaacaggattttatcaggatcgtagcgaagattaataaggcgcgtcctccctcgtccatccctgaattcgaggttaatgaggcggagcgtgtccagttttcgtaaggcttcgtaataaatcgtatatccgagtttgagtttcttttttacaatggtataaacctgaccggaagtcagctgttcatcctttctggataaatccacgaggagacgcaggagatccttctcttcccgacgcagggcctgtatggaatatttaagatgcaggaaccgggaaatcttatatgcctcatgaatatgctcctcgctgatctcccgcattgcttctttctctgcattcagacctgcccgcttgatcatatcaatgccaacccgcatgtcccctgaccgcagggtatgatccacgatgagatccaggttcttgtcagagaggactccgggatacagcccctgcaggacccgctcttttaagatctgaaatgtctctgtgaccgagtatggcggaaaatagacctcggtcggtgaaaataccgacgtaaccctgatgtcaagttcgcgggagagatccacatccatgtcagatatgataaccatgaccccgattctggtgcccggatatgtttcatgtgatctgaggagcaggtacaggatattattgagttcattctcgaaaaggagataattcgcatcatcaagggcaacaagaagtacccggtcctcggtaagcagaatatctgcgatggattcaaagacccttttataggagtttcctgcagcggaggggttatgtcctgctatctgccggtatatctgggagaggatcataaaccgtgtattctcaacctggcagttgatgtgaaccgggatcatctttgactttatctcactgatatctgcaaagatcttctttatcgaggtggtttttccggttccgggcgtgccttttattgtggcgttgagcggccgtgatcctttgatccctggccggagaagaaaagccagttcccgcatctgggactcacggtaattgaactgatcggggatgtaatctatctcaaaaacatccggatcccgaaacagggtctcatcccacatcagcatattcttcagggtcatccgcttttcccgtatctgactctcttagataacacttgcacttcatagatgcaggcgtaaaaacaaaaatatttcgttcctttcatgagttcccgaacattttctccctcaggtcatatctgaacttcagtacatggaaatagcttaagaaagaataatatgggcacgtatgcatatcagaacatttctcactgaatatctgccaatatttgtaaaagggcttctcatgggtatgtgtgatatcatccccggggtatcaggaggaacagtcgcattcattaccggtatatatggcaggttgatagcggcagttgcccatatctcaccagtcatcatccgggatcttatcagatgggaccttgcatcattcagggccagatttgaagagatggatgtagtttttctcatcgtccttgcagcaggtatcggttctgcatttctcctgatatcacgggtcatgctctggctgctccatgaatatcctgtccagacaaatggatttttctttggtctgatcctcgcatcatcagtcctgctctttgttcccctgccaggtcggtatccggggagttttatctttcttatcctgggggttatccttggcctcgggattgtaatgctcaatcctgctgctcttggtcactcatatcctatcctgtttttcacgggatttatcgccctgtgtgccatgatcctccctggaatatccggtgcatatatcacgcttctgatgaaccagtatgaatacatgctccatgccgtaaaaaccctggcactccctgatatcggggcatatcttgcaggaggtatcatcggtattctgacatttacccggcttttgaagtatctgcttaaatattaccatgacctcatcattgccattctgaccggtctgatgcttggatcatcaaagttgctctttgaccgggcctgtgaatcaaccccgccaggacttgaccttatcgtcagtatcatcgttggaatactggtcgtagctctgtttcagtatgtacagaccgcgatgaagaagaaaagtctgaaaaattaagaatttaggagataagaagggggatgagatcggttccggcaagcaggccatacatccctttcgcaccttccttctctgaaaaccgtgttgtatcgtctttgtcctttccaaggattgcaaaaggcaccggttcagcagtatgtgtttttatcctgattggtgtcgggtgatccggaagaaccgcaatcctgccattaaactccttcatgatggtaccaatcatctcatccacccgctcgatagcctttaccttctcctcaatactacccatatgtcctgcctcatccggagcctcgacatgtatgaagagaaagtcaagtcttttcaaagcctcaattgcatatctggcctttgcctggtaatcggtatcgataaacccggttgctccggggacttttattatctccattcctgcataggttccaatcccgttcagaagatccaccgccgaaatgattcctccggtaagccctgtcattacctgaaatgatctcatctccggacgcttccctcctgaccagggccagatggaggtagccggtttctttccttttttgacccggtccaggtttaccgggtgggtggcaaagacctctgtgctgattctcatcgcatcaagcagcctttcagcatcagcccctttgggaagataattcccgattgactggccggtgatatcatggggcggcgttgactcacagccatgacctccggggatgatgagaagattgcggtagctgatacccggatggcaaaccatccctgagagatgattattcagggaggcaaggagctgtgccccttcctcactagtgatatggcctgcattaaagtcatcgaggatgtcattttcgatggtaacaaggttgcaccggtatgcaacatcgtcatctccaagagaaattcccatactggcagcttccaaagcccctctgccggtataacagacggtgggatcgtacccgagcacagatagatttgcgatatcactccccggtgcaaacccgtcaggtacggtctttaagagtcccatagcgccttcaagggcaatataatccatattcggggtatgagctgcttcaagcggggtcaatcctgatagctctgcaagcggctcatctgccatcccatcgccgagaatgatacacaatttctctttcatattactccagggctgcccggacggctattctgacactctctccgcttgtgatatcagggacatatccaaggttcttaagtctgctgatatcaagttgcatctttggcacatcaccgatccatcccctgcttccgccggtatagtgatactgtggtgagagtcccatctcgctgcagaggatatctgctatctcggtgactgatatccagtcctctgatccgatattgtaggtattgaccggatcacgggtatgactgaccacatacatgatggctctgatacattccctgacctcaaggtatgattttgtctggttcccgtctcccaggatctcaagttcatgagggttttctttgagttttctgataaagtcagtgatgacaccatggcctgatcgtgcaccaataatatttgcaaacctgaatatccatgatcgcatggaaaaactgtgactgtatgcagatatgagtgcctcgcaggcaagttttgatgccccgtagactgataccggttccatcggagtgtacgactccggagtcggaatgactgatgcctctccgtacacggtggatgttgaggtaaagacgatctccgggacacatgcctttctcatcgcttcaagaacccggtgagttgcgatgatcgtattattcagctgtttttcaggtgcgaccgagctctcccgcacgtcaggatctgctgcgaggtgatatacccgatcagcaccagagaggtattcctgccatgaatcagagaggagatctgcgcttaccagagtgactcgtttctcatcaagatggttttttattgagttcagatcaccggaaatcagggagtctatgactattacgtcgtcaccggcaccgaccagatagtctaccaggtgtgacccgataaacccggcaccgccggtcactatactgcgcatccatactcatatccctttccttctacctaaatgtataacagcaatgtttgtcgggatcgatcatggaaccactgcgatgcgttttgccggaggggagaaggtgtataaaatcccacgagctgacgcagtttcgtttcaactctctgaccttttgcatctgaccggaggggaggagattgaagggtttgcggttacctattcgatgggtgataatttctcagacatcactccggttgcacacctaaaaaaccgtggtcttgtcagtcgtgagggagcaggagagcataccggaggcgggacccgggtatttgatgtgatcagggagagtgggattccggcggttgcagtacctggtctgcaccgtggttcacctacggatcccaggtttaaagtttactcccatcaggcaagtcctgagaagattggcctggcgtatgaggttgtgtgccaacttggccctacctgcatcgtttcagatatcagttccaataccgtcactcttctgattcaggattaccggatcgtcggcggatttgatgcttgtctgtttgctccgggctgggtgcatggcgctctggacctagatgccatccgggcaatagatgccgggaagatgacagcgaatgatgcgtttttacatgccggtgttcgggatagtctggatgatcctgaccgtgaggctgctcttgcgatgtttgctgccatggaatgtgcatccctgcggcttttagctcctgaagcacctgtcgcgttatgcggtagcagggccgggtcagtagccgatgagatcgcccgtctgctctcctgtgatctcctcatactggatgagtggacggcggcaaagggactctcaaggattgcagaagccgtattctctaaaaatgtcacacaaattcttggcatcccggtcagactgtaattttatatgattaatcgtgtaaaatattctgggaatattcttgagagagttgaggatccatgggagaggtggtcaggggtcggtcactgcagccgaactgatcgccgttgcagcctttaagagcggagtattttcacaagcctttccggcatttggagtcgaaaggcggggtgcaccggtccaggcttttgtcaggttctcggatgaaaagatccggctcagaagccaggtatatgaaccggactacgttattgtacaggacagcaccctgatcaaggatgtaaatgtcttctccggcatgaagaaggggggcattatcctcattaataccggtggagatattcatggcaccataccggaaggtgtcaggtatattccgatcgatgcaactaaacttgcacttgaggttcttggtgtaccaattacaaacaccactttgatgggagcgtttgctgcagcctccggggagataagtctggaagcactggaagaggcagtccgagaacggttctccggcagtctggcagataagaatgtggctgccagccggaaggcatatgatctgatcaagggaggtgcataaatatggtacttcgtatcggatgtgcagcagcccctggtcaggcacgggagaacaagaccggatcatggcgtgtcttccgcccggtttttgatcatgacaaatgcacgtcatgtgggatgtgccagctggtctgtccggaaggatgcatcctgactggtgataaacaattcaatcctgactatgatttctgtaaagggtgtgggctgtgtgcccaggaatgcccggcaaaagccatcaccatggaaacggaggagaaataaatgaaagcaattctcgaaggctcccatgcagtagcagaagcagtcaggctggtaaaacctgaagtcatatctgcatacccgatcactcctcagacgcatatcgtggagcggcttgcagagatggtagctgatggtgccctggaaagcgaatatatctgcgtcgacagcgaattttccgcactttcagcatgtcttggggcatcagcagcaggatcacgggtgtactcggcgacatcatcacagggcctcttgttcatggcagaagttgtcttcaatgttgccggtatgagacagccaattgtcatgtcgattgcaaaccgtgcagtcagtgctccgctctccatctggaatgatcagcaggactctctctgtcttcgtgactctggctggattcagctctatgcagaggacgtgcaggagacctttgacatgcatcttcttgcgtacaaggtcgcagaagatcaccggatccttctgccggtttttgtctgctttgacgggtttatcatatctcacacctatgagccggttgatattccggaagagaaggatgttcttgcatatcttccaccctatgttccgttcaataaactggatgctgatgatccgctgagcatggggatgtacgcaactcctgaatattacatggagttcagatacgagatagatcaggcgatgggccgtgctcttgacgttataaagcaggcaggaaaagagttcaaggaaaaattcggccgtgactacagtgaacttgtcgaagcataccggctggatgatgcagaggttgccatcgttgccatgggatctgtctgtgggaccattaaggatgccatcgatgcaatgcgggcagagggaagaaaggtaggtcttctcaagatacgtgccttccggccgtttcctgcagaggatatcaaaaaggcccttgccggtatcaagaaagtcggtgtgtttgagaagaatgtctcaattgggtcacggatgaagggtgccgttggatatgagatcaaggacgccctctctgattcttcagtacaggttcttagttatgtcgcaggacttggcggacgggatatcagaattgaggatattaagaagatgacggatgctattgaggctggaaaaggggattgtttcttcggccttcgtgaggagctgatctgagatggctgacagaaccttagaactggtagattcagggcaccgggcctgtggtggctgtggtcctgcatttgcagccagattaattctcaaaggagccggggagcgatccatcgtctgtgcttcaaccggatgtatggaagtcttttcaactccctatcctcagacggcatggaaagtcccctggattcactctctcttccagaatgctgcagcggttgcatccggtgttgaggctgccttaaagcggcagggtcgggatgagcatgtcctgtgtatctgtggagatggtgcaacctttgatattggtgtcctctgtatcagcggagcctttgaacgaggccataatatcacctatatctgctatgataacgaggcatacatgaacaccggtatccagcggtctggtgcaacaccctttgatgccagtaccaccacttctccagccggaaagaagagctttggaaattccaggccaaagaaggatatgcctcagattcttgccgcacatggggccccgtatgtcgcaacctgttcgattgcatacccgaatgatgtcatcaagaaggtagaacgggcagtgaacactgacgggccgtgctatattcagatccacaccccatgctgtaccggctggggatttgacggatcaaagaccatcgacattgggaaactggcaatcgagaccggtctctgggtcaattatgagatcgtgaatgggaagattgagaaggccaagaaggtcaaacgaaaaccggtcgaagagtatcttcgtgttcagaaacgatttgctcatctctttaaaccctccgtcaatactgaagagattgcaaaaatccaggcaatagccgatgcaaatgcagaaaaattcggtattgatctgaagatctaattcttttttcatcctccgggatctgatacctaaaccttatataggctacaggtaaatgcgtaccaatctgaacggtggtcgcgataatccccgtactctttgttgatgacaatcgggagctctccaatatcttccagttctatctggaggagaccggattattcactgtacatgtatgtctggatggtcaggatgcacttgaatacctggatacccatgacattcaggtggttatctctgattttgacatgcctgacatggatgggatcacccttctgcgacatatcagggagaaattcccaaatctaccgtttattatgctcaccggcaacgacagcaaggagacagcaatagaggcattgaattccggtgcagatttttaccagaataaagctgaagatctggaaatccaggtgctggacctttcccacaagattaccatcctcgtagagaaagcacgggcagaggccgctatcaagagaaaagacctgatcctggaagtgattggaagaactgccggacgcctcctcaagggagagaatttctttgcagagatgaagaccactcttggggaattaggtcaggtaaccggggcggcaggggcattcattggagatccctgcagtcattgtgatgagagtggagctgaagggccggatctcatcacctggtggaatgatgagggagagaagacgaaaagcgggcttcgcgttctctttgcagaacttctcagtgctatggaaatggatcacaccgattatccgtatatgcttatcagttcagaggatgcgtccccatccggacaggaggctctcaaaaatctgggtgtatcttctgccgtatttcttccggtctcgacgggagatgagcgatggggatatctggcccttttctacaccgaatcaaaaaagtatctttctcaacccgaactctatgcctataccatgctgactgagcttgcaggagcagccaggtaccgggcatacatggaggattatttcaaaaacccggttgaaaagtcacttgtcggtgtgtttctcatcagaaataaccggtttctctatatcaatccacgtttctcaacgatattcgggtattcacgggctgaaattatcagatcgaaatctctccctggtctttttgaaatgcctgatgcagaaaaggtcagggaaaccgtcgaccagatcatgtccggatggagagagaatgcccatcttgaagttactgctcttaccagggaaggttcacgtgttcagattgagctctatgtgaccatattcagatgtaatggatccctctgtcttatcggaaactgccttgatataacccagagaaaagaggctgaagagaaggtccgggcacaggaagaccttctaaagcagaatatgatgagttcactccaggagaaagaaaccctccttcgggagattcatcaccgggtgaagaataatatgcagattattgcaagtctgcttcgtctgactgactttcagagtggcaacccggaggttcacgatgtcatccgtgactgcaggaaccggatcttctccatggcctccattcatgagaaactctaccagactgatgatcttgcacaggtcccgctcggaagttatatccgggacatcggaaaccggatcatccttgagtttgagatggaggaggggcggattctctatcatgtcgatgaagattcgccggtttttgttgatatcagcaccgggataccgattgctcttatgatgaatgaactgataacaaacagcatcaagcatgcattcacagataccgggaatggaataatcgaggtttgggttggaaccgaaggagaggccggggtcgtcagatatcatgataccggtcgtggtcttccagatgggtttgatcctgacaatcagacaacgctgggaattgaacttatcaggaacctgaccgtacagatccagggaacggtccactttgagtctggttctggaatgacctgcacgctgacattcccgctcagaaagacacccgtccctgaaaccatcatcggagagggaatatgacatccggtcatcagattttaatcgtcgaggatgagatggtcatctcaatggaacttgcacagaccctgaagagacttgggtatggaattgcaggtcaggtaaccaggggagaagatgctattctaaaggctggcatggtccgccctgaccttgtccttatggatatcatgctgcagggagagatagacggaatagaggctgcagaccggatccatgatctgtatgacattccggtggttttcctcactgctcattctgatgaggcaacattgcaacgtgcaatcgctgttcagccatcaggttatctgatcaaacccttcagggaccgggaactatattctaccatcgagctctcgctgcataaacacgatctccgcagaaggcttatgccacatctctctcagcctcttgaaccagaggtccctggtgatgtgccctgcctctttctcactcctgactggataatctccgggggaaatgcaaacgccttcgaactcctcgatgtgtcaccagattcatgtattagaagacgatttgatacgctcatctccctgaatccgtcactccgggttaccatgcctgataaaatttacatcaaaaaaggtgatggaacacgcatcccggtcctgctcagcctaggagccatcaccggagcaggagggtcaatatccgagtatgtggtagccctgactaggagggatactcctgcctgatgaatacacagttgaaacagtggacgattgtaaggtagatgaggtccgtgccctttttcatgcaggtgactggtgggaagatgaatgggatgattccatcctctgtgaaattgtcagatccagttatgcatttgtcgccgcaatcggtccggataaccggtggattgggatgggccggatcatctcagacggggtttcagatgcatacctgcaggatattgtggtccttcctgaatggcgggataaaggggtaggaacggcgattgtaaagaaactcatgaccatctgcatgcatgccggcatcggatggattgggattatcgcagccccggagactgaatacttttaccgccggttcggatttgcaaagatgaacgggtatacgccgatgagatatgaagggccgatccctgccagagaataatccatcctgttttctctgaacatggctgatgtgaaacgcccgcttatcaccgatgaaggaatcctggtttctgcagtatgtccggtcattatctctgccagcagagcaacagaccttcctgcatattacgctgactggttcatccaccggctaaaaaaggggtatgtccgctggatcaacagttttaatccccatctcccgtactacgtgtcatttgaggatacccgggcgatcgtattctggagtaaaaatcccctgccaatgttcccgcaccttgactatctggatagcctggctcttgtatactactttcaggttaccctcaccgattacgggtcggaaggtcttgaaccgggtgttcctccccttgatgaacggatatccacattcatccggttatctgaacgagttggccgggatcgggtgatatggcggtttgacccggtactccttacccggacccttgacatagataccatcctttccagaatcacgtatatcggggaccggattgcaccatataccaaaaaattcgtcttcagttttgtagatacgtcctattcaaaagtgaaaaagcaggccggtatctggcatttcaggaatccagattctgtagagaaacaacaatttatcgaggggattgtcgggatgaaccggtcctggggaatctctcttgcatcttgtgctgatgaggccggatatggtccggagatcgaacataacaaatgtgttgatgatgccctgctccgactgattggtcagcatgatcctgcccttcttcgataccttgatactcatccgggtaaggatcccggtcagcgtcctgcctgtacatgtattaaaagtaaggacatcgggcagtatgatacctgtctgcatgggtgtgtatactgttacgcaaccgatcatgcaaaagcacacgtgaattatgagaagcatcaatcgagtccggaggctgaaaccataaccggtgatgccttcggtcagcagaggagaacagaccgggatattcagtcgtatttattataattacacattccgtcaacatgaaagaatagtcaagatctcggggagagagtaccatgaaatgcatgtactgcaaaaagggtaatcttaaaaatgactttattacaaaatcgtatgaaaaggaaggagttgtgacagtaatttctggagtacccgtccttatctgtgacacctgtggtcaggagtttcttgaaggaaaaaccgtgaaaactttgaaaataatcaggaatgggaaaaaacctttgggatgtaagaataaattatggattattcattatgaaatgtgaaatatgtggtgaggagatatccggcgggtctgcatttacctgtaattattgtggaggggtttactgcccgaaacaccggctgccctttaatcatgcctgcaaaaatcttgccgaatggaaaaaatccggattgccgggtaagaaaggcaccagaagaaccggaacgggtaaggcttcagcaatgatcccgttttatcagaagaaagaggttcttattggcgggataatcattgcagcccttgttattgtaattatgctaatattcctaaaaatttagtataaatttatctagtataaataatttaaggttaatatattatattaatgaatgtaatttccatatttctttcttaatttttctgataatttttgatgttcaagaatatcttcctgagttatcttgtgtattcccacaacccgcactgcatcctttggagaagtatattttgtttcccaaattttttttgttatcataatacgcccccttaaagaggccgttgcataacttttaactgttagtacaatgagacaaaaaccagaaatttcattagcaattttggttccaatcgaagggaaattgccgtcttacggaaacgacatttttgttatgcaatatctaccttaatctgctctaaaattcgtcacaaaaaaatcgaaatttatttgttttcttcaaccacaatcaaaatatgacctaattcgtagttccggttggtggtggaattccttcaccagtccattcagataatttccgaaattttgcttgttgttcatctttcctcgttatacattggttataatcactttcatctcccttgaccaggttaaatttttttacaccactcaccgttttccctgcataagtggttccatcatatgtagtatagtaatccatcatatcattaagatggctttcagcccatacggaatattcaccaagattataaacaaaatcacaatcactaaataaagctccggtattccatccatccgtttttgatggatttgaatgatcagtgccaactcctacccaataccattttttatcgccatccgtctcatccacggggagattatgtaaagagagtgatgcagtatcaaggccggaaacctcaccccgaaaaattgaattccgaggcccttcaatcattaggttaattggtgcttcatcatctgtatagccatttcgattgaaaacagcccctaaatttgtattgataatgaaattaacgatatgacctcggggtattggttcatcagttattatccgcttcgttgtcgtatcataaacctttagggctagatagggttcccttactttaaatgcaagttctcctttttgtgatccatcccagagaaagaagtcacctgcatgcccaataaacaaatctggagaaacaaagaaattttcgggttcaggaatatcaaggatatggtctggttccctgtttttatcacaataacctgaactgaaataacctgttgggggcggtatatcattcgaacttacatcattatttgtatcctccctgaaaaatgaggagtctacctcggtacatggagcataccaggcgatttgggtgggaatattagtaatatctgttagatcaaggccattctccccgagaaatacaatatctcccggagatattttgttcaaatttgctgaaacggggcataaattcaaaacaagaagtaaaattccagcaagaatcaaccaataataattttttatgtctaatttatattatgtaaaccaagtttaaagatatgtcgaattattattccctccatagaaattgatatcgttgttttgagaaatggttgaataatgaaatccaattgtaacaaaagcaatttttcttatcttcacacagttgctaccatttagaaaaagtattcagttttggtaaatatcccgctaatcagaaaaagtcattccttaaaaggggtaatattgactggattaatattggaaaatggagagactatctactaaaactgatgattaattcacaatccgcatgatatcttaagtgttttctcatagatcatttgtgaaacacgaaaggagattctttgaacattctctaaaattcaaatttaatctcaacgaagtgtgtttatctatccgtcctgtgtttatctgttatccctatttaacctgacaaaacgttattttggtcattgataataggtgggtaaaaccgatcagatagaccattcccaatcgagatcacatactctctcccatacggcccgtcttcgatcccttcaaccagatcccaaatcctgctgtcctccccgcccctgacaagggcgatacccagaacaaccgctgcaacagtatcagtatctcccccaagctgtattgcctcttttagtagcctgcagggatcattcccatatttggccagaagaaagatcacgactccaagaaatatgcgtgattcggtatagggaaccccgtatggtgcgtactcaccaaggagaatctcccggtcagggatgacaagtcctgaacatcggtcacaccagaatatgatatccgggctcatctcacgcacctcttcacggataacagcccaaagttctgaaaagagtgtttcatggtatattcgttcatgggcaaacagagcgatagccacggttgcagcaatagcatcgggatgaccatgggtgattgacgcactcagcacagccgatttgataaccgtcttccggtcagggaaaaacccaagtggtggggctcgcatagcagcaccatccgttttccgctcactcctttcatgatcagagatacttttgaggaatgactgagggtctggtgaaagaagcatccggagagtctgtcttgaatacccttgccgtggatctcgtacataagcggtgagaaaagattttgcaagattaaatggagttatctcatctccgaatgccataatttctgctattgccagggcctgctgggtatcatcggtgtatcggcccggtataataccctcagcctctaattttttcgttgcatcctgaaatgagagattttcaaatgaagctccgcaggcatcaccaagggcaatcccaaggagcatccgtgctccgggagaataatattcggtcaaaaaaatcaggggattttagcgcacttcaggcactcgtggtatcccttttccttgataagtttaagaatctcccggggattgccatggcacttaaactcaccgttaatcatgacatgccctttatccacatcaaggtaatcaagaatatacccggtgtgggtgatgacaagaccactgttcttccggtttacaaaccgctggttcttctgaagcaaccgggcgatggactctcccatgaggtgaatattttcaagatcaactccgctctccggttcatcaagcatgataaaatggggatcctggatcatcatctgtaatatttcgcttcgcttgatctcaccacctgaaaatccgaggttgatatccctgcccataaactcctccatgttcatccttgaaaccgcttcagatacatcctccggctttttattcgggcttatgacattcagcatcttgccaagtttcagaccagggatagaaggaggacgctggaacatgatacccattccaagtcgtgccctctcatggattggcaaatgcgttacatcgaccccgttaaatgtaatggacccctttgtaatagtatatgcatcaatacccatgatgcacatgagtaaggttgatttcccggacccgttcgggcccatcagaacatgagtctcacccggttcgatgtgaagggtgattccatgcaaaatctcctttccaccaatctctgcatgaagatcttctatgtgaagcatattgtactgtacctttttgatttattgcgcctgaattccttttcggaatggtttaaaggatccgcttccctgcttcagctcccggcatacactcatacacttcggtgattttcaatatgagaagtgattttgccggcaggttcggtttcttctcatggatcatagctttcattttcgcatgttcctcaccactggtcttcaccgtgacatcagcttttatctggtaacatccctttgcgccggcaccatatacatataatgcagcttttggattttcgagaacatttgcaagagttttctgcatgaaattatctcctatccagatcgtctcatcatcaactaaaaatactgaagccatgggtgcaacattcggaattcccgactttgatgccgttgcgagaggaaacactttaatagcttccaaggcagtctttatctcaggagtcagtgcagtcatggtacttgagtttctctggtatcataaaaaggttcgggttttatgtctcgttgctcatcgctgcagggaagataaccctgaccaccgcaccaccatcattggcaagggtcatggtcccggatagttccagtgcaaggttttcgatgatagtaaatccggaggttgcgcttccggttcggataattgactctggaaagcccctgccgctgtcctgaacctgatagatataccagtcttcttcacgccgcaaagagagctcaatccgccctggttggccgggggtgaaagcatgacgtatcgcgttcaggataacctcccccgtgataattcccagaatggcagcatgtttctcaccaatggcatcgtcaatagcacaggagatgacaatctcaatgtcttgcatctcctcagcgaaatcttctgtaatacacccgatgataagccggatatatttacagagatgaactccggctccccttcccccgcccgcttcgtagagctgcaggatagcttcaaggaggatcttgccataccgcatatcatgttcaggttcagcggctatggacaggaatttctggctgaggacatttctgacgatctgcaggagggtaatataggtgtgccggacctctcttgattcagaaccggtttcggtacctggttcagcatcatcccgtgactccggactgatggtccagatgataaggtcccgatcaccgctctgaatttccctggcaactatcctgacctgttgccatcccgccctggtatcaggcaggtcgacctggtctgcgatggagaggccttccctgatctgttcgatgacatccctgctgatgagaccgctctcacgaagatctactccggtctgtccgagaggtgagtatgatgaggcataggccaatgcagcatggttcatctcctggattcggagatcggacgcggtggtgataattgcggggaccgggtttcgtgagaagagatcatggtacaggctgtcccggctgagagagatatcctgcagttcatcagtccgtgacgcactcaggatcatgcctgccataccagagggtttgaatagtctgacaaggatagaacggatctgaccatccggaaggtttacatgaaaccgggcactactccccccacccgcgagaacctgggttttaaactcatcaaaacgcttatgttcctctgcagggaggagatgggtaaaaagaagaccggtgaccgccccctgatcataccccatgatatgagagactgacggggttacatatgatatctgtccatcaggactgagtaacgcgatgagttcctcggtatgcgagagaagctgcaggtatgtctccggagataagaggccgtttgtggtgtctggaaccgcttgactgagtattctgatgatatatccttccagtccggagagtgcgagcggacctttaaaagatccggatccgatcaggattccctctgcgggggaccggtcctttacctgcagtctggtaaagataacaaaggatctcttctcattcaaaccagtctggatagtctttctgaccgcatcgcgctcctccggatgaatgagatcgggcagagagataagaccggtgtccaccagttcagcaggagtatacccgcacacatccctcgccccctcgtctgcataggttatggacaaagcagcgtcagcctttgcccgaaacatcatccccactatatgtactttattttccatggtccccccggacagaacatgttgattatcagatttcctgtgatgtataataagaggcggggtatagttttattgatccgtgaggtacacaaagaaggattcattggttgaaacccgtgtatttaaaagatcacttcctcctgttgctgctcctttccctgactgtgatgctggtcatggccggggagtccatgctcactgccgctctgccggagattgaacatgaattctccgttccaggtatctatgagtcatggattctcccgattgtcctgctcgtcggagcggcagcttcaccctttgtaggaaccgcaggggatcggttcggccataagcgtcttcttatcatctgtcttgtgatatactctgtcggtcttatcagcggacttgtggcccctgatatctgggtcctcctctttggtcgtgccatgcagggggcaggaatagctgcctttcccctggggtatgcgatcatcaggcaacggctttgtgagactggggcagataccggtattggtattatcagtgccatgtatggtgcgggaacattcatcggggtgataaccgggtcgttcataaccggtcttttctcatggcgggtgacctacatggttttaatcccggctacctgtatcctgcttctttgcatctggaagtatatcggagatgatgaaccggtaaacgggcatggttcactcgattttgcaggattcttctctctgctcctcttcctgctcctctccctggtttttttctccctcccgacagaagaccagatcggatttttcgggctgctcttacttgtgtctgccgtcctcgtatttgggctttttatccggatcgagaggcgggcgtctcatcccctggcagatattcaactgatgaaaagacgcccggttgcggtgttcatggtgatcgggtttctgaccgtattcacctttttcgtactgcttcagatgatgccctatatcatccggcttcctaccggacttgccctgtcagccgaaatggtcggattaatcctgattccagggacattatgtgatatggctgcagggccgctgaccggacggatgatcccggttatcgggtgccggcttccctgcattaccggctctcttctcctcctcagtgcgggatgtctgctctttctctttccggtaacgcttcctgtcctggtgattgcctggatggtcttctcattcggaatgtccatgctcgctaccgctgatctcatcggagtgctggagtttatcggggaggagcggactgctgaagcgaccggaataatccagagtatgcagacacttggggggatgatcggtcctatcgttacaggaattatccttgcaacctcccaggttagcacgatgtatttgggagagatatgggagatccctaaaaccggaacttattaccaggtctttctggtggtgatcatcatcagttcacttctcctggtaatctcctggatatatgtgaaggacagacggaaagaaagaaatgaacatactcatccatctgtgtgagaaaccatagtatgacaaaaacaaatcttcgttgtccctttgataaagaaccctgtatagaggaacgatgtgccgtctggtctgaagtttttgcctgctgcagttttgcaatgcttccggaccttctcagaaaaagagcatctgaccatgagaaaccggtaagacccggaacagatatatcatcaggctcagggaagtaccggactctgctctttgattaacggagctatggcatctcttcaacttttatcatatttgtccgaccttcctttccggaaaaattacccgcgattattaccagctgatccttggatgtggcaataccggtaacctttgcaatttttaccgcagccctgaagagttcatctgccgactggataggatcaaaaacgaccggctggattccccaccggaggagaagtcttctggcaacagccgggtcaggggtcagagcaaggaccggagatcgtggtcggcaccgtgatacacgttcagcagtcagacctgatcttgtaaatgcaacgattgcaggactttccagctcttcagcaatgtaacaggcccggtaactgatgataccttctacattcttctcatgccagtcggatcgttcattgaggatacgaaggtagggaaggtgttgttcaatctcgatcgctatccgggccatcatgactactgcctgacccgggtatcttccgacagaggtctcggcggagagcatggttgcatcggttccgtctacgattgcattggcaacatcggttacttccgcccgtgtcggtctacccctgctcaccattgattccagcatctcggttgcggtgatcaccgggattccctgctggctgcacgtggtaataataagtttttgaatgtacgggacttcttcaaggggaagttcgacaccaagatctccccgtgcgaccataactgcgtcagcatgccggatgatgtcatcaagtccttcaaccgcccgccgacattctatctttgcaataagcgggatatttcccattccttcacgggtgaggagggttcgtgcatccctgatatcctctgccgacccgacaaaggaaagggcaatgtaatcaggcctgagtgctgctccctgcctgatatagtcgataaaccgggcacctgcatagggaacatccggccttcttcccggaatcaccacccccatcccctcccggatggttccgcctgatatgacggttgtgagcatcggggggccgggttttaagacctgtaatgtgaccgccccgtctcctaccagaaccacgtctccggggcagacttttgggatgcagtccgggggatgtacgtgaatggcaccagacgcatgctcatgctcagcggcgatgtgaatggtatctccgggaaccacatctctgggcggggagtgaatcagaaccctgagtttgggaccgggaatgtcaaccaggatacctatctcccgattcagttcatctgccagtgctctgatttgctgaaccgtttcttcatgccagggtggtgatccatgagagaggttcaggcgtgcaatatccatccctgaaaggatcatctccctgataatccgaggatttgatgatgctggtcctattgttgcgattattttagttcttctcatggtgcaggatatgccgggatcagaaggactggctcgcctcttcatgatatgggagatgttgagttttcgaaagataaaaggtaaactctgcatggtatgatcggggtgggctataaacccctgaaacgataacagaatactgcgatggatgttgcagaacgagaggatacgcttctatccttgatgcgccaggcacggttgaccggacaggggggaaggccggaagatattgccggtcatacctctctctctattgaacaggtcacggaggtactcactaaacttgtcatgaatggtgaggtcacctaccagaatgacggggcgtatcacttaagtccttccgggattcgggctgcagaggcgattatgagacggcaccgtgttctagagacctttctgcaggagatgctcggaatggaacatgaactggctcatgcacaggcctgtaccatggagcaccatacaacagacgacaccatcaaccgtcttcgaggatttctccggggtaaccgtgattgcccggtgacttgtcatggtcatgtcagacgatgttcgtttaaaagtctggcagattgtgctcatggcgacgtagttaaaatcgatgccatccggggatgtggcaggggcggacgactggcagatctcggtcttattccgggagaaaaggtgatggtgaaacagcggatggcagatacccttctcatcagggtgaaggattgtgatatcgcgataagtccggagattgcccgatcagttctggttgaggtggaccagtgaagattgggcttatagggaatccaaacgttggtaaatcactcatattttcacatctgaccggtatcggggtggaggtcagtaattatccggggacaacggttgatatcctctccggagtatcctgtatcaatcgtcttccggttgagataatcgaccttcctggtatctattcgctggatggtgagggtgatgaggaacggctggtcagggatatggtcctctcccatagctttgacgtgctggttgtcatccttgatgcggttcatcttgaacgaaacctctatcttttcttgcaggttcttgaacaccgtatccccatgatcgccgtcctgaacatggcggatgaggcggaaaagcaggaaattcagatcgatacacatgccctctcacaaattaccggagtcccggtcctgctgacctccgcaacacttgggaaaaatatcgcagagataatccctgttgcaacgacaagagcctcggtcgggacctatcaggtggcatatgaccgacatattgaggctgcgatcaggactctgatgcgggtatctgattcagggtcatcacgggtagcgtcacttcttgcattacaggggatcgggactgacccttcccttctggaagcagcacgaaccattgccggcgaactggaagaagagcaccggatgccggtctcatccctccttgccggtaacagacaccatgcagcgtcagagatacaccaccaagttgtgtcaaaagcctccgggaaagagatgcgcggccttgacagctggctgttgacgccgtttcccggtgtcctgattatggccgggatcctgctctctatgcttctcgctgtctttttcatcggatcattctttgaagaactcatcgttgaggcatgtgatatctgggtcctgggtcccctggccggtgcttctctggaccctctcgtgtatgaactcatcttctcctttgttatcgccattcaggccggtcttgggattgcattcccttttgttttcaccttttatctcctgatgtcagttgtggaagataccgggtacatgagtcggatagcatttcttgcagaccggatcatgcaccggtttggtttacatggccaggcaattatcccgatggtgctggggcttggatgtaatgtaccggctatcatggctatccggcagattgggacaaaacgtgagcgacatattgctgcatttctgataaccatggtcccctgttctgcccggacggttatcatcgcaggaattgtatcggtctttgtggggctttatgcagccctttcaatttacctgataatcttttccctgattctgctatcagggctttttctctccaaaattacacctgggacccaactggggatggttcttgaagtcccgccactccgggttccgtcacctttaatggtattgacacgggcatggattcacatcagggaatttctcgttattgcaatgcctctcctgattgtgagcagtattttccttggtcttctcgggttttacggtgttctggatgtcattgaaacagcaacagccccggttgttcagggtatccttggccttcccccgtttgcatcaactgccctcctctttggtgttctgagaaaagagatggcttttgagactctggtggtgcttgcagggactgcaaatctgaccgaggtgatgacccgcattcagctctatatattcgccctggtcagcaccctctttattccctgtgtctcaacgattgcggttctctatcgggaacagggactgaagacagcgatacagatatctctctatacggtattccttggatttattgccggcactgttgttcactggatcagtacccttatccccttgttttaaaaaccagaccgtccaggtacagtatggatccccatcccctaattcttggagggacaaaccgttccactccttccgtcattccgatttcaaatccatactcactggtgacctttgcggaggtctgtgctgccgggcctgatgagattgaagaggccatacgaatagctgaacagggagcagttcggatggcggctctccccgcccacaaacggtctgaactgctctttcaccttgtacgactgatggaggaggaagctgatatcctcaccgatatcatcgttcgtgaaggggggaaggtgaggaaatttgccgcagctgaagttgccagggcaatcgggacgatccggatatctgcagaagaagcggtccgtatccatgatcagatggttccgatggatggatacccggcaggggaagggagaattgccatgataatgcgggtgccggtgggaattgtattagctattactccgttcaacctcccgctgaaccagatatgccataaagcaggacctgcccttgcagccggaaattcctgtatcattaaacccccgtctgcgaccccgctcaccggattaaagtttggtgaactgctgattcgtgccgggtttcctaaagaggccgtcagtgtcatcccctgcaggtcagatattgctgaaaggctggcaaccgacaagcggatctcatgtttgagctttaccggcagtccgtctgtcggctggcatcttcgatccattactcctgcacgtcatgtcacgctggaactgggtggtaatgctgcagtgattgtgcatgatgatgcggaccagacccttgctgcaagccggatcattgagggcgcatattcccataccgggcaggtctgtatttcagtccagcgggtttttatacagcggactattgcatatcgcttcatctatgaactggtatcccgttgtaatgccctcgttaccggtgatcccgaagatccggcaacagatgtgggtccgatgataaccccagacaaggcaaaagaagccctccagaggattgaagaggcggtcagccagggggcacgggttttatgcgggggcaggctttccggtcaccttctgcttccaaccatcattgcagacaccacacctgacatggccgtgaactgcgaggaagtatttgccccgattctcacggtaacgccatatgaatcatttgaagatgcgattgccatggtaaacgactcacggttcggccttcaggcaggaatatttacgaaagaccttggcctggcgatccatgcttcaaagaccattcagtgtggtgcggtactgataaacgacattccgacattccggatagacagtatgccctatgggggtgtaaaagagtcaggaatcggaagagaaggcccctattatgccatccgggagatgaccgaggagcggcttgtcatcatcagatcctgatattttcttaaggaggaaccagagaacataaattccaatactgagatattctggtatactattcaccggaaaaggggtccggtgatatcacttcagacggggtcattcatgaaagtcgagaagaagctgctgatgatcataacctttcttggagcgcttgtagttcttcttctcatattttatctcatcaccgggtttcagtccggaatcaaggatctgatcggttcggtatacttctccctctgggttactgccgtgatgggtctgtggctctacattattgatccatatctgaaagggaggccaaagaaaaaggatcagaaagggacgagatcagaaccggtcaaaaccacaccggtgcagtcaccacggtcaaacctcccgctccgcgaccgaatccgtgaatatgttgccgaacggagaaaggaagaaggcttacctgttcccgaaccacttcgtccatcccgatcctcaacctcctccggtgctggttcatcatccggttcttccacggggtatgtgcccgtcgctgcaggagccgcagttgccggggccggtgcagcggtatcggcaggggacagcgatcttcccttacctgatgactttgatgagagcggggccgcagatctcttcggcgatgaataccctgaagatgaagaaggcgaggcatcacttcccggaattgaggatgatgactttggctcgtttgatgaacccggcgtggatgagcagccggtcaccgaatcaggggatcttccggatttcgaaggggaccttgagcctgacgtgtctgattcaggatttgatgattcaattgaagatgatctctccggcaaggatgagggatcagagtctgaacagagcggtgggctatctgatgagggcctctcggactttgatatgccgcttgatgaatcaatgatggacgatgatctttcaggtgatggtgacctgaccgatatcgagtttgaagatcttgaaccggacgaggtctgactttattttattcaccagaaacatgttttttctggacatggtacctttgtgatccgatgaatcataccctgccacactatcaggatatacctcttttattgatactcgttctgctcctgatttctctttgttcttccacgagtgcggtatcgaccggtccgtctttggaaattaccggtctgtccggagaagagattgcccatcccggttatccctataccgggaccgttaccattgcaaacaggggggatcagacgagcgggatcgcctcactctatgtcttctttcgatccccaggagatccggatctaaatgcgaccatctgtgtcatcccggttgatcccatgcagcccggacagagtataagtctcccctatatcgggacggtttcttcagatctttttcctggtgagtatcaggtttatgcgtacataaaagcgaccgggtcccgggatcctgagaagacagggatacttgcacgaatcccctcccctgtctccctgacttttcaacctctcccgaaccagtcagtgatcaatgacgaaatcatcgctaccatccgtgaaagtacaaatgagaaccggatacacgaaggactccggccccttatctgggatgaggatctggcgaggattgctcaagcatatgcacgtgaattagcccgtgccggaagactctcacacaccgacagaaacggggacgggccatctgaacgggctttggcatttgggtatccggtgacaaaggatatcgaagggggggtgcggataggcgtagcagagaatcttgcctatatcgggaccggaatagtcaccggagtcgggtatgttgatcccaccaatggcactgcaattggcacggccctcatggacggatggatgaagagtcctggccaccggaagaatatccttgatccgcttgccgatagatttggttcaggtgttttctggaatgatgagtattattacgcagtctctgaattctggtaactataaaaccaacacacataagcggatgaaatcagaacctatatagactacctgtacgatgccttcatgccggatactatggaagatactacaaaaccagacaaatcccacaaatgggaacttcttctcaagccgggagtttgctggtttatctgggtgtatgaggacagaattgagttctgtctcccctccggagagatatcctcctcttctgaatatatggatattgaagggagttttccccccgatatcgcatttcttctccatgagatcatccgtgatgcccaggagatggtcccgggtgatgcaaaaaagattgtgcttgcaatccccggaactgattcaggctggcccgggcatctcttccgcctctcatcagggcgtttctctcttgtatggacaaagaacgggaatggtggggctgaacctgactcctgtgacctccttgatcatatcaggagtgaaaaagcggtcaggaaagcgaacgagaaactgaattatttcaacgctattgtccgtcatgatatcatgaatctcatgatggggataaacgggtatattgatatcatcgatgagatcgtggatgatgatgaggtccatctgctcatcaggaagagccgggatcttggtgaacggattttgcgtattgctgagctgacccggacataccaggatctcggaatccgccccccctccttcatcgaggcaggccaggcagtgcagaggattatcaaccgccatgaattctcaggaaaaatcgtgtcagatgttcagctgaatggcctcttcttatatgtagaccgaatgtttgacgtggtcatctatgagatcgtgagaaacagccttcagtatggcggagaaggggttactataaccgtctcattagacaaggtgcctgaaggtctggcgttggtatttgaggattcaggaccaggtgttcatcctgatttcaaggagagaatattctcccgtacgtatgcagaccggaagggctatggactgtatcttgcctctgagattcttgatttaaccgggattggtatcagggagaccgggatatatggcaagggtgccaggtttgaactggtcttcccgcctgatacctaccggttcgggccatgaacctcaggaccgtatctggtgtaagccggtaatggagagcaggtctgaaaaccggtcaatgatgtggtctggggtacattcaggattattttgtgcaaagtaatccccgtatcgtgcatagattgtgacaaacccgagttcctgtccggggattacctctcttctgactgagtcaccgaccaaccatatggtccctgttaccgagagttcacgaagtgccatccggaaaggggtatgatccggttttctttttcccgaacggtcaggagtgatgagcactgggaaatagcagtcgatgtcacattttttcatccgtttcctggcctgctctgatcctgcatcggtgacgatggccattttaataccgagggatgcgaggtgcctgagtgtatcatgaaccccgtcataggggtgtatgtgggcgatctttacgtcttcaaagagccgggcggcatggtcagcagatgccggggtgtatactcctttctctttcaggtagtcaaagatgtggtttggatcttcaaatgaatgtactggccgaaggaaatattgaaagagttctgtttcatctcctgtcccgatatagtccgtgaccgcacggcaggctgcatattttgcatcgatgaaggtacacagggtattatcgagatcaaagaggattgcatctgggatacagccggatgaggtgttcatgggcgtgtacatgttgcgttcgggtaccaaagtatgtttgtccctgataggggtgcgtagctgagcgattttcagggccggtatcggtaaaaccatattcaagtatcgctcatattttcattcgcgtatcaacggaggtgtgcaggacatgggttgtcctggataacatgagaaaggatctgacaatatctcttgatgaagaatatattaatgcactgctggagattgcagaaaaccagaaatcgaccctttcagcacttatccgcgatatattctcgtcatatattcaggcagttaccaggggagataccccggattttaaggacctgaccaatgctgaaggtgaagtcgctggggttctgactgtatccacggacctttccgggacggttgctcgtcatgcggcactgattgccgatctcgaacgccgggtcggtctacttgaaggacggactctgaactctccctaccaaccacaaaaacccatgtttgcccctgatctgatggcactgacaagtccggtcgggatctcatcgtctgccggagttattgattctgatatgcctccggtcggcaatcttgctgaggaagccctcgttaaggtgcagatgcagccggttgccccggtgatggatgcgatggagatgggttcgatgaagatccgaaccgataaggagtacagccagaccgaggcagcagttgctttagggatatccgttacaacgatgcggaagtatatcaaagaaaagaagattgctgcacggaaggttggccgatcctggcttattcatgggcgggatattctcgctcacaaggctgcagcacaggggtaaaccagagagtttttgtgctgcgccactaacatactgtataccgggcattctccggtgtgactggtggggtttttgcaccggtgtatgccctgggatgctgcatgcagggggagcatgcgaataattcatcatattctgtttcctgtactgtttttcatcctggtactgccggttatcattctcccgcctcagttgtcaggagatcctgatgagatcattccaacaagaaatctgatgcttcttggtgagtacccgagtgatattccggttgtcagggaagagcccggtccggttctgattttttcagccgaagaagcggagcgccccgcaccgtccctgaatgtgaccgccccggttcctgtcggaattatagcgccgaacgggaagatggctccactcacggctgaggggcctgagaagccgatgggaaaagggtgggtccaggttagtctgtccacctcggttgacagtccgaccgagatgattgaggatcggcagcggtacatggcatccggtctgtttaatgtgcatgtataccacaattttgccggatagaaattgaaaatccttatatgttctgaagtataccttgtaaggcgcacgggcctatggtctagttggttatgacaccgcctttacacggcggaggtcgccggttcgaatccggctgggcccataattttttattgttatttgtctcatgaatcttacttgtttggattatttctttaatttcatttagggacttctcgattagtttgtgtgtgtaataatctgttgttgcaacaattcaggttttagaaagtaatcaaatgtcgcgaaatattatcccataggataatacctcaaaaatttattcgggtttcatcttttttatgggggaaagaaattaggatttaaaacacatgccaaaattggtaattgctcaacttcctaaagttgagtggttacaaaaaaaagttttttaggagcgtattggggtttccaagttcaaaaaatcggataattgtggtatttttagatcctcctatagaccggaatcaactttgtccattcgtccagcattattcaagttactggtaccgtgattctcattcagtggggacaggggcaaatctctttccttctgctaaatttaacgatcctagcggttcaacatttgtttgtccatgatacttttcctcgacagcttgtcccaatgagactatgggaatcaccacgttgttcctgcagtttcgcacccgtttattgctaaacatgcacatgcaggtagggacgcccagaatagattgggtggcgtttccggtttttaatcgggttcgcaatccgatttactgcttctagtcgcactcaataataattattcttggtatgcactctcctggtacgtcagatgatgactaagtacccaaaatatggccattaactataatacctcttctcatccaatatcaatcagaatggatatcaaaggaattgaaattatttgctgtatcgctcttttttcgctcatggtggttggatctgctgatgcaactttcgggtataaaattctcttagagggaggagagagcattatcacagagaatgaagacgggagtatgatcctgacgattcagaatgtagtcccgtatggagttatttttgacgatcctgagtatattactctcctggaaacggtattgccagatacgaattccactatgaatgccggtgtggtattgagtaatccggatggagacaatacgtcacttgttcaggtttcacagctggattattctgctgaaaccaaaaatctgaccttcgttattcatcctctggaattctatgaggggagtattcttgctgatctgaaagaacggtcagaaagtttgaatcctgatatcgtcagaaatgcacatgtcaccagaatttatttagagaaaggattgccagtttctgaaaattttggtgatattaaccggtgcatggatgattgtgaaagatatcatgaaaaacctacccggtttttttgtgagatgaactgtgcgaaataacaaccttaattgccgggttactaatattttactcttatttcttacatttttttaaaacagattggaaaacataagttccccgatgataatctggcatgtaaattgtcataatgaatcagggtaacatctgtacatgcatgcctcttccagtggttccgatgaggaatggtttgagaacgaatccttttgggaagacttctatacggtattatttccagacgaactgtttgaacaggcggaggaagagatagagaagatcttggatctcattgatcacccggtgagttcggtccttgatctctgctgcggcccgggacggtttgcaggtctgcttgccagagagggatatcaggtaactggtgtcgacaggacgccatttctccttgagatagcgaagagagagtatgctgatgcaggagaagtggaatgggttctttccgatatgagggagtttgtccggaaggaatcatatgatctggtcttaaacctctacacctcttttggatatttcaaggatcctgcagaggatctcctggttttgaaaaatatctcccaaagtctccggcaaggggggtcatttgttattgaggtgatgggaaaagaggtgatggccaaggattttgaaccgattacagcgtcaaagaccgaagacggactatttgtccaggctcatgagatcctggagaactggaacaggattaaaacggaatggacccttatcaaagaagggaatatcagaacctttacgtttgaacacagcctctatgcagccagtgatctcatcaggctctgtgagttggcaggtttttcggatattcgggtatttggtgattttgatgggggtccctatgatcattctgcatcgctgctggtaatcaccgggaaaaagagataatcctgaccatatccggagtctgctggtttggcggtggggagaacatacaacacccttaccgtacaagaggctaaaatcattaatttcgacattattcaatttatcgcctttaaatggaatataggagggtgatatttgccgttttaagatcttctcatagccggccggtattgtgttatcatggaaaagtctatactttatatagctatgatccggaacttgatagcggcctttgagtgaattggtttccgttcgatttttacgatttagagcgacatttgctctcctttattttgacattatcctgataatataaatatcgataatttaggtcctaaatctaaaaataacccgaatatagatcaatacgaggctgagaaaagagatgtccgagtattcatgaaacgaatgttcactcctcaaaataatccatatcaatctttttcacaatataccgcgattcatctgacactcctacattatgatctatcataagttcagctaacgtctctccatcaattaaaaccactttctgttcgattcgctggacgtattcctgggcttcccttgagaaacgggaagtggtaataaaaactccttttcgtgcccggttccctgcaagactacccacaaatgcctgtatctctggtcttccaaccgtattctgccatcttttagcttgaatacatacggtatccaaccccagtttgtcctcttttataatcccatcaatcccatcatcaccagtctttccaaccctctccccagcttcactccgtgatcctccatatcccatggagaccagtagatcaacgaccagtcgctcaaaaaactccggtgagctattcataacctgtgataatagttcatgtgccagtttatttcgaacatcctgataactattctcaagaatctcttgcggggtcagggtgctctctgcagtacctgattcttcttttaatggtgaatgattgtctgttcgaaagtctttaaaatccagaaattctggaaattgtttgagaaagttttggtcgatgcgttgtggattctgactgagtactgctaaccctcgttcggtgattttcaccttcccccgtgaaggagtattaactaatcctgcttttttcagatatgtcttcgcccaaccgacccggttatgataggtagactgtactccacttgggagtttttggttcagttcttcttcagaaagatgaaatgaggatgctatttgactataaatctcctggactgagtgttcttttccatcttttacagctaacaggaccggaagcaagaatgtctgataatcaggtattgccattatcttatgggatatttgtatcaaagagcgataaggtattcgaaataattctatttgaaaaacacggatctcccgaacccaaattacataaatttaacttttattgacataaacatgtgagatatgtatcgtaaggggtatggattcacccctctttgtatattctgtatcgttctatgttcaacctcatcagcactcaaattccctgataaatttcaaaatactaaccctatcattgcttcaccacaggaaaacaccgaaaaaatatctgttggaattttggtgatgcagagtggatttgtatcagataggagttacgcagttaacttttattatataaagatctatatatattgacaacgcctataatatacgtgcctataacgaagcagccttcagatgtagattatatcaattacctcatcgcagctcgatgcgacgtttcttgtgtaaaagtcgctgattgttattcgacgtctgaattctcgatatcacatgataccttcaatcgattcctaacaagacagtctctaactcctgagacgttgtgggctgaagttgaggcatatgttgacagaaaaaggggctggttggttctggatgacactattctagataaaaaacattccaaaaaaatcgaatgtacatattaccagtggagtggaaaagagcacaaagtaatcaaaggaataggattgattgccttaatttggacagatggaatcacttcatttccaattgattatcgaatttatgataaggatgttgatgataagaccaaaaatgatcatctccaagaaatggccttgacagctttcaaaagaggatttactcctgcctttgtcatgtttgatagttggtattccggaaatgaaaatttgaagttgattaaccgtcttggatggttttatttcacacgagttaagaaaaatcgtatggtcaatcccgatgccaaaggtaatgttcaagtgtcatcattaaatataccagaggagggattagaagtccatttaaagaaatatggatttattcgtctttttcactcactaaatcgtaaaggtgtaagtagatattgggcaaccaattttttgccgatgaataatgaagataggctggttttacaatctatttgctggacaatcgagaattatcatagggctatcaaagaactatgtggtgtcgaaaaatgccaagctagaaagggaattatccaacgaaatcatattaattgctcacttcgggcatatttacgattcgaagtcaataaatttttgaatggtgttactccgtacgatgctcaatggcaaatcataaaagttggaatttcagaatatattcagaacccaaaatatgcgctataaattttttagaggttgttctgcgtaactcctatcagatattggtgaagaatatgaaagggcttttgagatggtagaggaggatcatcctgactcgccaattcagccagttattatcgatgcgggaagcaatgtgacaacggcaatttctgcatggaataccttgaaatcggaataccctgacctttttattgttgtaacagttgccagctggacaaccaatgtggtgtaccctgatgctgcagatgatgggaaggtccagattgctcttgggagtgccgtcgtaaacaagagtcgcttgaatggcagacttgttcggttcactcctggggtggaacaggaatctccaatccttgcagaatacctgtctcaatatgaccgggtggcaatcctgggtggggagaacgattatgcacgtgggtatattaacgccctgaattcccttatcccggaaaaaatcgtagatattgtgcagtatgatcctgataccctgcctggcagtctggacctgaccccggtcagagacaacaatcctgatataattctgctactcagtatgtcagaagccgaatcggttgcggaaatgataagaaattgtggcatatctgcaccacttgttggaacacgggtcatagaacggaatactcttcttgaaaccccggtcgcagatggcctcatctttaccattccggcactcaatcgttcttttcccttcttctccaggtaccgtgaagaatatggggaagaagcaacattttacggggcagaagggtatgatgccatgaatatcctctatgatgcagttgagacctgtggggaggatcaggaatgcctctcatcctggtttaccgcaaatcagtaccctggttcacttggcgacgttcagtttgatgaaaaccgggtggccttttatcctatcgaatttaaaatcatcaggaatggctcgtttgaacattatgaagggaagatagccgttcaatgaaaaaccggcctgctgataatttgaatgacacttatattacataaatattataaaattaaatgatatccagaatatacttttctttatgaaaattggcttatattaaaatgagggtaggtattgaattcaaaaatgaaatttaagcctatgtagcagttgtaacacttgtagcagatccagagaagagacctgtcagtttttttttattttagaggagacataatctgattcgaaaataccatccctcttccctgaatgaaagagaatcttatcttatggaaaatgattcctcattgtgtggtattatgttatatatgcaaatacgtggtaatgataatacgaaatggaacgattcaaactgccaattggtatccaatcttttaaaaagattcgaactggcgggtatgcatatgttgataaaacacgtttcattcaatcgttagttgataacggatcatattactttctttcgaggccacgccggtttggaaaaagccttctccttgataccattgattatgctttttctggtaaaaaggagtattttctagatctttatctcaacacaccagaagcatcatgggatttttccagtgtttatccagttgtcaggataagtcttggacaacgtatcaacaggaattctgatgaactgggtgaatatctgacccacatactctctcttgaagctgaacggtataatgtagcctatgatagatcattatctcccggtttccaattggatcttctgattaaaaatctctatgcaacctatcagatgcctgtagtcgttcttatagatgagtatgataaaccaattcttgatgcgattgaggatagtgaaaccactcgtatattacgagatgaattgaaaagtttttatggcattttaaaagatctggacccttatcttaaatttgttctcctcaccggggtctcaaaattctctaaaacgggtatcttttctggtctgaacaaccttgatgatatcactcttgatcccaggtactcagctatctgtggatatacccatgaagatcttgagcaggtattcagtgaatatctgatcggctttaattctgaagagataagggagtggtataatggttattcatggtcaggtcagactgtgtataatccctttgatatcttaatgctcttttccaagaagatgtttcgttcatattggtttgagaccggtaccccttctttcctcatcagattatggcagaaaaatccacggttccctggcgattttgatggattgatagctggtgaagatctgcttggatcttttgatgttgataatataagggttgagacgttattatttcaggctggatatctgacgataaaagaatggacttctgacccggtacgtggatttcaatgcacgttaggatacccgaatattgaagtgcgaacatcattaaacctgttattttgtcagtccttatcaggattttctgtatccgggatgcgaaacttgttatttgaggttttggagaagaaagatggagagggattaaaagagttttttcattcattttttgcttcaatttcgtatgaatggtaccgaaaaaaccatttatcgtcttttgagggatactatgcaagtatcatgtacaccattttcgcaagtcttggatatcacgtgatcgcagaagatactacaaataagggacgcatagatttgacggtaattacggctcaggcggcatggatctttgaatttaaagtgaaaagagatgaatctcacggagagaaaagtccattggagcagataaaaaggaaagggtattctgaaaaatataaagccaagggtctgaagatatgggagattggaattgtatttgatccgaaaacccgcaatataattcaatgggatcagagatccgattaatttttactacctggatgtgggggagtgagagggtataaaaaaaagattaccctctgtaccaatagaactgctacacgtgctacaactgctacatggggtttattttaacattcagtcagcatttcctgctaaaattcagtactggtgaatatgctgcaaaaacgaggtgcctcatgcagacatatcaacataaaatatggagatggcgggaaacatccctctcaatcctgttcgttcgtcagcagaaacgaatttataaaccgttatcatacttcccaccctcatatccgcagagaccagtacggggggagttacatattggaagcaggtagcactcgtccaggtcttcatcagaactacagtcatcacaaagcacggtaaaatcatcattttcaatataatgataactggctggttttccacattcagtgcagggaaattccagtttatcattcataccagccataatgatcttctccttttccttatgccatgcaatggattcagcaaccttcagcctgagttcggtagttgtcccaaaatcgtattcatagagaaatgtcatgcccggtaccaggactttctgtatctttaccttcatcgatttggcatcaccaaaaaaatcgtccatacctgattcagaacatctctggtactcgactcccgtaatagtaaacgcacttaaatgaccacaacattcaacccagatgtcccgtaacgatctatcaagatcttcaagcgttgcattaggtttgacaagaagaaccatccagtatggagaggaatacggggtatcaaccataatggctaatctctcctcacccgtgtccggagcatggtttttcttcatatgcgtaacggcggttcgtttggttatcggttccttgcagaggtaacatgttccaggtgcagcagcttgtttagccatgaaaagagtgttggaaccacatgatgaaaagggtatttcttctggtccatcgaccatagaatccgaattttctcatgccatgtatatcgaatatatttaatctttggaaatcaacctaatcaaattaggagtgtaggtatatgaaaatgttatttatttgtgcattactcattggattagtaatgcttcctcttggagttatggccgaggagggtactcttgttgaggatgaaaccgccggggtaaatatcagtgaagagattgccattgtagaaacaaacacaccgaatctggctccaatgtttggaaaagtacaccagactcttctgatggctacagaagaagcatttggatatcttctgaccggtgatatcgctgagaaagaggcatttttcaaagagctagctctgtcagaggaagcaatgactgcgtttgaaggagcagcatctggagcaatggaagatgagcaggttattgttacaggatttgacgaggtcaagacctcttatgcaaacttgactgctgcagctgataccatgtttgtttcatttgaaacggaaggaaaacccgtaatggatgatgttattgcctttgaggcgtctgtggatatagtttttgatacaactgacaaggtatgggatgagtataacgttgacggtcctgcaactgttgatgccagtgtccgttctctgtatggccggttacttgctgcggtacaggaatcatatgcctatccggtccttggagatatgattgaaaaagaggatgctcttgctgactttgccgattttgacactgttattgcacaatatgagcagaaatatcctgacgcatcatatgatgatattaaagcaatgaaggcggagatacaggcagcagcagaggcaatgtttgcatcatttgaggagaatggcacggctgatccagcggatgtagccgctcttgaaaccctcgttgaagaaatgaatgaaaaggccctcaaactctttgacacatcatctgaagagacagtggtcatcgaagagagttctgaaattgaagaaacagcagtgaataccactgcataattttttttcttttctctattatcctgcccatcgtaaccgggcagttggaaccagcgttaattgaccctgacgaaccgttatcaggtgggaccaggtcatgtatccgtcatgagttatcgtaatctcatgagttccggcaggaatgccagccctctcgagtggcgtggaaccaatcatctcaccgtcaaggaatactgtttcgttctccggtgttgaattgaccatcagcactccgttcggtaaggttacatatttttgacctttcacatacctaagaaagagaatgaacatatacctgcgaaacggactatttgggctattacttcttatttctacaataggaattgttgttggtgcagaaccttcaggatacaccgtgtatgtacaaggtgcagagagcagtattgacagaacctcggatgggatatataagataacgattcaggacgtcattcccttctccacgatttttgaaggggatgagaggctgttgcacaaacacaaaaaaagcttaatataaattattaaagcttaattatatatattattaagatcaatatattatatgtctcatcgctataacatgattagaggatatggtaatgaacaacaatttttactccctgtcaatgcgatggactggctatctgaaaatgatattacttatggcatattagaaattctttcgattctcgatattagtccatttattaataaatatcgtgacgatggtcgcggttctgccttttttgatcctcgttcaatgcttggaataataatttattcaatgattcgtggagaaaaatctagcagaaaaattgagatgtgctgccattatgatattggatatcggatcgtcgccaataatcttacacctgaccatacaacgatctatcgtttcaagaagaataattcaaaagaaatcaaatccctttttaaacaattatctcaaattatcgtagaatccgggatagcaagaatcggtgtcctagccctcgatggatcaaaatttggctgtaatgcctctttatcagccaataaaaaattaaaataccttgaagcagagctaggtcggctttttgatgaatcacaggaaattgatgagttagaaaacgatgatataaatattcaggatatggagattaaccgactacctgagcatctttcaacaaaagaaaaacgaaaggaagttcttaatcgggctaaagagaaattaattgaacgacatgatatcgaatctaaaaaacaagaagaaaagattctggaccgcgaaaaagaagaattagaatcgggtaaaaagaaacgaggtagaaagcctttagagcctaaaaaagagccatcttcagattcaaaagtaaatctcactgatcctgaaagtcagataatgtcaaccaccaatggctggattcaagggtataatgggcagattatcgtttctgaaaatcaatttatcctcgctgcaatgatatcagatgagcaaaacgataaaaaattattaatacctatgctaaatgaactcgaagacctttttacgggtattcatccatcaatttcgcctaatatactactatctgatgcaggttatttctcatacccgaattctttagcagaattggattatggcattcaactcatcatccctccttctaaagaaagaaaaattccagaatattcagataatgatgggtatatctcacgaatggaaatgatatgtcgggcgatttgtatgggagaaataatcacatttccggaattgcaaagtatcgggacgtttgtttggcaatcttttatgaacagagagaaacaagcaacaactcaggaaatttgtaaacgagttatggaagtacgtgtgaaatcccccactggtagagagttatatcgaaaacgaaaatacatggtcgaaccagtttttggtaatatgaaacataatatgaggtttaggagtttctctcaaaaagggaaagagaattgcgagggagaattctttttagctgcattagtgcataatataaaaaaacttatcagatttgagggtatagttaaaattaaagaatttgctacgaatattataaaaccgtcaagaggttcaggtttttcctatatttttgcaaacacagtatgtaaagtgggaattgatacatgcaggttcatacatcaattagtctattttggttgatagcttaaggggtagagatcgatcatttgtgatcctgcatgatattgatcattggtgcaacaccctcatgagctgttccttttccagacaaaacatattgtaaatgaaaccaatccgatgaatgcagttcttatactgagcggttctgaaatggagctgaaatctctgattgagatatccagtatctccatggatacagaacagaatatcattaccttcctggcacaccccttggagttcaattcaggggaacttctcaaacctttcctgaatggtatgggagatctggatatggcaacaggaaagagagcaaatctgactgctttgtatcttgaaattattcatccggttgctgaaaataaatggaatccgcagttcccgtgttgtgttgagggtcctggtggtcagtgttatatgaagtgttaatattctgatacttttttttttcatcaactcaattgttcattatgaagcttcttctggccagtgaagaaacttcatgattcagcacatcagatatctggtattcatatcttctgtgggggagtatccatgaatttttcagaaaaaaatatcctatatgcaggaattggaataagtatcctgctgtgtctcctgataccatcggtatgtgcaggaccgtctgataactggttccctgacaatcgatggatccagcaaatttcaggtcagaattatcagaataccatccagatatctgaagaacatgcacctgaccggcttattgtccggtataaaccagaatcgatgaaaagccagtctgccatgatgtcggtacaggcgatggcacatgcagaggcaggatcccgggtagttcgtgatctcagcacaagcggggttgtggggatgcaggtcgtacaggtgactggaacgagccttacacgtgccatggagatctatgaaacaaatcctgatgtcctgtacgtggagcccgattaccggatatcacttagtccgattgaaaaaaccgggacatctgctccaattcaggcccagagttttcgtgcagcaggaacggggtggccaaatgatcctggatattcccagctctggggtcttgaaaataccggtcaaactcccttttatggaaaaacaggggcagatatcaaggctcctttagcctggggggcaacaaccggatcatcatcggttgtgatagcgctcattgataccggcgttgattattcccacccggatctttcttctaatatctggcaaaacccgggtgagtattcaaacggggctgatgatgatggaaatgggtatattgacgatatcaggggctggaattttgtctcaaaaaataatgaccctatggatgataacggacatggaacacattgtgccgggaccatggcagccgtcgggaacaatggaatcggcgtgactggtgttagctggaatacaaagatcatgccattgaagttccttgactccaaggggtccgggtatacatccgatgctatttcagcaatcctctatgcaacccagaagggagtccccatcatctcctgttcattcagcggtccgggagagtcccttgccctcaaagaagcgatagattcctcttctgcactctttatctgtgcagcggggaatgctggtgcaaattctgacattactccccagtacccggctgcatatccaagttcgcagataatctccgttgcagcctctacctatcatgacactctggctacgttctccaattacggaacgagttcagttgatcttgccgctccgggagtcagcatctacagtacgacaaaagccggagggtattcttatctgaacggtacgtcgatggctgttccctatgtcaccggaacagccgccctgctcaaagccagaaatccctcaatctctacaccacagatgaagagtaagattctgggttcatgcgatgttcttgcatccctttcaggaaaagttgcgacaggcgggaggctaaatgcggcaaaagcgcttgatgtgtccattcctacgccgactccgacaatcactcctgttcccacggtaacccatactccaactccaagcccgactccgacatttactcctgttcctacggtgacccgcactccaactcccagtccgactccgacatttacccagattcctacggtgacccgtactccaactccaagccctactccgacatttaccccggttcctacggtgacccgcactccaactcccagtccgactccaacgttcactccttcaccaacacaagggccggtccctccgtgcggcgtttataaaaaagatatccagtctggttttctcaggcagggacaagcagcagtgtacggttactatattccggttgatggacggtcaaagattgagtggtcattaacagtccgtggaacatgtggtgctggtcaggggattgcaaccgcagcaaaaacaggaggattgaaggataataacaatgcatgtgccggttcatcagtatttgatctgtatgtgtgcagggattgtaatccgcagaattcacggtgttatgctaattattatgcctatgggccgaatgcatacacctccataacaaagccggcgtctggttcaacgtactttgtgatgatctatgccagatccggaaatggtatatatgacctgcagatgaacagttacaaatgtacagggaatactcccattattgtagcctctgctgaacaggggatgcagatggccggaactgacagtggggcatctcctgcttccatcccggtcccgacagccgagtttgtgtagttatgacttgactgaaccgtacatatacactctttttttggacaatgcaccggttatcccgctcatcatacaaaccttaaaaaagtcagaccagtgaaatggtcatgagttcaaatcttccatccttaaatccccaccggtccatagcactggtaggtgcatgattcatatcaaaaatcttcgggccggtcaccccatagtatctggagttatcaagaccctctttgatcatttcagccgtgatattctcctctccgtttccattcctgaatgcatcggcgataagcatcatggaatcatacccatatcctgcaagggttttcgacggatcattcccaaatgcctcctggtatgactgaacaaaccggtcagagtggtcgcctggcacgagatttgtgtaggcagagatggtaaacaggggaaaccgggagagtgcatcagtctcttctttctccagattctcaaggcatgatgattcggtcaataatacctgtccccggtatcctgcttcagaaatattccggataagaggaatctgccgtgtatcatacatgatgatgacaatcgcatccggagctttatcgaggattgtccgggtaaatgatgaaaaatcattctcctccgggagaaccgggtatgtccctgaaatctggaaatcttgctctattaggccctttaggatgtgattcaggaccgattctccgtatttatcctgaacatacaccagggcaggacggtctgatgtgtaggccagccattctgaaacaaattgtgcaagggcgaatatcggagggttgacctggtaaaagagcggtgatatgccataaagagattctccgttcgcctggggggatatgaggagcgtggtatctgattttccggtttcccgtgccatcggaagggtcagggtagttgtataggatccgataaccacaggaatagaatcggtctgcatctccttgaaaagagtcaatgctctgtccgggtctccggtatcatcagcaacctggagatctacctgatatctgcatgtttcgtcagcgtttatctcatctgctgcaacctgaataccctgaagaagatgagaaccggccacactatcatcgccgctcaatggaagaatgactccgatagtaatttttgccttctctggttcaagagcagaaaccggaacaatgcagcaaagcaggatgagcataagaaagccggcaacggaaatatgcctgcaattaatattgatatctaaaatacaggattgcttcattccggttgttccacattggatgtttgcatgaattttattttgtttattcggatgcatcgtatgttcctccaaagaagagagttaaaggtaagtcaattgactcacaccccctggatatcgtcggatgggatgatctgacattataataaacattctggtacaaatgtctgatcgatccgtcaaattcgggctctctcaaaattgtaatcaaccgggaggtaaattcgtctgaaagccagtttgagagttctgagtcataagttgcagcctttgatgtctcatccggtgcagcagcagttattatgaccactccgggagtggtaatctctgatgcaataactccggaaaaacatgactcaaggactaaaagcagctgtccaaacctccctgactctttcatttctgtcagggcatcggcgagttctttcggtgagatatatttactcccatctccgacgacaatatctcctcccggttgtccatgagaggataggtagataagaacggtagagttttcgtcggatttgagcaaagggtctccggcctgtgagccctttccggtaaggatgtcaaggaacatgcctttattcaccagctctcccgtaaggtcaggaattgcatcctttcgaacttcctcaacagatggagtatgatacacctccccgggctttttgtttcttgtatcggtcggaatgtcatcatatacgagcagggtaatatgatcatcaggcactccctggtcccggatatactggtacatggtcagggcatctgcctgatgccggtaattctcccagttatgggataggcttccgataactgcccagaattcaccgggtggatgaggggttggatcaggagccggatctggagattcattcaatccgaggagtagtccgacatcagactttgttgttctcgtgtaagcaatcggatcttcacggaccattccctcctgtatctgataggtttcgtaccagggaatcaaccggtctgtaccttcttccctgaaggtaagagggccggttgctccggtgaggatcggtatatcccctgcaagaatctcatccaatgctgcctgaataccctgcactgttcgtggaattgaatctcccgtcccttttgtcaggacggtcatagcagcagtctttggggatatatccggaaaagccataaaccgtgccataacctgtgcaccggcaagaaccgcatcataggcctctgggacatatccggaggtgtcgccatgtgcgattgcctgatactcttcagaaaattgtaaatcccaaggcttttgcataaggataagggtgtcatcaggaactttggttgatactgtactgaccgtgtcaatcttccagagtccggagtctaaaagagcctgtaatgtctcactatctgcccgctcccatacccggctgtctgaatcgatatcaggatagaccagatacagtttgggcggggatggcacatttttgagagaactgatgacctcacgtatctcacttccttctcctgaatggatgaatatcaaaaaatccggattatctgtcagtaatcgtccgactgcatcaggaatctcctccgtggtgttatatgtttctgctcccgtaacggctatcccctgttctatggcccagtagggaatccagtcataaaatgtctctccatatgaactgtttatggtgaggatcgagacatacttcccgtcatgggctttgatatgctgcatcatgactgcagtggtctccccgtcatttgttatggtccgccatacccctccggttcctgcataggcacgatacatctcatcagatgaagcagtcggtgagatgagcaccctatgattttttatgaatatttctgatacctgaaagacttcatctgaagtatatgggccgataaccacccgtatcctgggatcacggacaaaataatccgcatacgtcatgatatcaccaagccgtgtatcccggagaattaactcaagcggtcttccaccaattcctcctcctgcattgatctggtccctggcaagggttatggcatcatataagggctgcccctccggtccggaaagggggagaagtactcccatgtatattggttcagtatcggcacaagccgtcgatgagcagagaatgaataagaaaaaaagttgaatgcaccaaaatgaggatattataactgatttattatgcatagatggtccattgtctttcatatagtaatgcggacctttcagataaatttccctgttttacatgattataaatacatggaaaatatcagagaaaatagaaaataaagaagagtcagggatttacccccttcatcgggcgatggcagtatactgcccactatcctcatcaggtgtaacgacaaccctgatcgtacgcttactcccgtctgccgtctgttttggtgaataatatcccagcgtgtatgtatgtgtaataatcccctggatattgttgagaattgttgaaaattcttccccatgaatgtcaataaagagaccacttccgccgagggcctttaccagctcccttttatcattctgctcgttaaatgcaccagagacggtcgtcggcccgacaaggacaaaacttgttccgttattgagcaaattctccgcagtttcagagatgatatactgtgaaaatggagagccatcaccccggtagtgggtcaggtcatcggttatatcaatgatcatatgctgtgcatctgacctgaatcccatctccagggcagcttcaatggcatcaaggtttgcttccggtgcatcaaacccttcgctggcatgtaatccgtcaacggcctgctgtatgaccaagggatcggaagtccattcctggtttatggtaaccgtgtctttaaagctgatgagtgcatacctgcagtcaatcccggcgagagcgatacttttcgtcagccccataactttttctttggtttcattgatctcgtcactcatactgccggtatcgtcaaagaggatggcaagatctagttttgatgtcgtggactggtctgaaaacgcgaatgaggtgatattcatgagttcattatcctcaaacacctggaaatcctcctgtttgagtgccccgttctttcctgcagtgctgttaaccgtgacataggtcatgatatagggaaagttcaccccgttaatgccggtaatgtctacaacagaagttccatacgtgctgatgtcatcaatgtcccggatttgttgctggccctgcattcctgaagtgtctttggtctctgacggtgcaggagagaatatacggtctttctgaactttgaaaagtccggttgctgaatctgcaccaactctgatctcaagggtgattttctggtcctcgccatacattcgtggagtgaaataactgatggtataggtatgggtgattatggactggattctatcaaggatggtggagaattcatctccatggatgtcgataaagagaccactgcctccaagtgctttcacgatctcttttttatcggtatgcacgttaaatccgcctgatactgatgaaggcccgaccagaatgtaactggttccgttctgcagcaggtgacttgcggtttcaggaatagtatactgagaaaattctgttccgtcgccccggtaatgggttatgctgtcggtgatgtcaaggatcatgtgctgggcatcaggcctgaaccctgacgaaagggcagtttcaatggcatcaaggtttacttccggtgcatcgtctcctccatccgcctcaagactgtcaacagcctgtttgataagactcggatcagacgtccatccctgccggacggtgagggaatcgcgaaaactaatgagcatgtacctgctgtcaatattcgcactgtcgatggcatccgtcagttcattaacccgtgctttcatatcggcaatctcttcgctcatgctcccggtctcatcaaagagaatggcaagatccagtttggtccgtgatgaagtatccggaaactgaacggaggttatctccatcagatcaccgttttcaaagacctgaaagtcatctgcagtcaggctcccctctcttccttccggagtgttaaccgtgacataggtgatcacgttggggaagtttaccgcgttaattccggttatgccaagaacctgtgattcagtgtcatttgatccttcagatgcagccacaatatgggctgtacaggcaaggatgcagagtccgatgataagtatgatacgtgctgccgttttttgatgcatgaaatacctccttgaattacaggagtattgcatgtgggctgcatatatatttcgaaatcatcctgatgatcaatcatataaaatttaattttctccggattttttaagattcgaatgaaattataattgttcgggacactaaatattatgcatgtcacagggcatcaggtatatacaacgtcttcaaaactataaccgtgcccttttgatggtacaggaaggggttcaatcatatacctcgcgtcctctatcaaatatggaaaaacaggggttcatcaaatccttcgaatttacgtatgaattagcttggaatctgatgagagattactctctctatcaggggcatcaggagattcgaggttctcgtgatgccatccggcttgcgttatcaatggatctaatttctgatggtgaaatatggatggatatgcttgaatgttgttatattacctcacatacatatgatgaaaataccgcagaagagattatgcaaaagatagctttccggtatttccctgctatggtagcatttcaggagaagatgaacaggattgccaatgaaggataaatcttctttcggattatcagagatccaattagaacgaatccgaaattcattagcccgatgtccccgattaaatcaggcctttatttttggttcacgggctcttggaacatatcggaacggttctgatattgatattgcccttgatggagaggaactgacgtttgaggatatactcaggctccatacccggatagatgatctgaatcttccatactttgtagatcttgtccatattcagcgaattgaaaactctaaccttctggatcatatcaggagggttgggaaaaaaatattttctcggtggccgaattctcatgattgcctatgaatatttggtttttttgggagtgctttttttggtagtcgggtctgatattcctaaattttcttaccatttcctatacgctcatggaatgtgtttggaattatctgactacatctggcatttttatcaccataaggtatggctgcgtcctttttgcatattcaacatataccacagtctcattagagatatctggccatgcctcattatccggtcctgatgaaatctggtattctttccgggaagagagattatacccatacatataccagtttccattccgctcatcaatccagacaacctgatcccccgatatacggggcagccactgtctggagggatctgttgttatttgtacctcttgtctggtggtcagattcatatcgaaaatatcaaaatttccatacttttgcgactgccagactacccattctgatgaaacgcccgggaaccagtctccccaggatgtatcggtgacctgtacctctgtcctggttggaaggtgaaaggcatagatatctccccgtgaatgggcaccatctcgccagtcctcccagactatccagtctttatcgatatccggctgccattgaatatcaggaacatgactgattatctcctcttcaccggatgagaggttgataaggacaatgtcttcataaccgtatagttcatccacgaacaccacattattacccgatacatttttcttcagggggaataatagtccagacatcagactttctcaggctttcctgcgtcataattctggaaattgcaattaaatgagctttgtttcactatctaaaaaaggattcaatcagatatctttgtcagagaaccgtatcgttccatcagggcagatgatctcaaatcgtgccccttcattgaaaacaccagtctcttcgatcataataccggtgatggatagtatctcacgtgaaagaaataatccctgaccggtgtttttcccatactgatactggaatatctttttcttttcgtctgattctataccagatccgtcgtcttcacagatgatccggttggtcccgttctctctctcaaacctgatacatatttttgagatcttgcctccatatctgactgcattttcaatgagatttgaaaagaccttttcaatgaggggatctgcatatatttccaaatcttctggaatctgattttccagatgtacgtgatgcaatgaggtatgtttcagcgatttagagacaaggttcttgcaattatgccatatcggggtttttattccgatctcctgatattccttggtgaatttcaccgtattgacggtctgtccaagaattcccacggctttgtcaatataagaccatgccagatcaggattttcttttcggtccatggtcgccagctcaagatatccctgcagtgagttaagctgatttaaaaggtcatgcctggtgatacttgccatcagttgtagtttcttatttgcattcccaagagccgtctcaaccatccttctctcatggttctcgactgataggtcatggttacttttttgcaattcttcaagggttttttgcatttggtcattcagataatgaagtttctcctgggctacctgcagatctgaattattcttaatcgccacctcataggttgagaggagaatgtttattatctgcagacgggtggcggtaatggtatacgatcgatcagaaaatattacattaagcggtgttggtcgatcattcgggtctggtttattaatggcttgcagaatgcttccaatgcgggtgtggataacttcgggcgtatagggtttgatgataaaattgtctgcgccagcttccagacccttgatgacatccaccggattgaaaagatgggtgaccaggatgactggaatatctgatgtcgcaggatcattttttattgctgaacagagttcatacccgtccatttcaggcatcatgacatcagtcaatacaagatggggacggcttttgctcatagagatgagcgcctccttcccgttggtagcaatggttaccggatagccctctttttcgaggacataacgcaaatactcgccctgtgttcggttatcctctaccacgagtatggggaccgatgagttttgaaccatatcagccatatctatcctgaaatcagactattccggtcacagaccatgatcctgattacattattattgtgtactaatagatgcaaccctgtatgaactttaggatttatgctaataatcctttcaccgtcctgaccagttcacttcgttcaaatgtgcctttcagaatgtacgcatttgcccctgatgagagcccgtgttcccgatcttccctcgaatcaagtgcggtgaccagaacaacaggcagatgggagagccgttcatcattccgaatcttctcggtaagggaaaacccgttcatcctgggcatatccacatcagagacaacgatatccacctcttcttcaagaaggatactaaaagcctccattccgtcactggcagttgtcacctgaaaaccggcattctcaagggtcctgcgtaagagtgcacgggaagtaaccgagtcttcaacaataaggacctttccggatgtctttcttggcggcaggggggcaggtgcctggcctgataaccgcagcccttcttggatcagttcgggagggtcaaggaccagtgcaagttttccatctccaaggacggcagctccggtgatcttctttactcttcgcaattgtgttccgagcgggcgcacaacgatctcctgaacctggattacttcatctacggcgtatgcgatttttcctgcaccatacgcaactatcaataccgggatttctttggacgggtcatctgtcccgaaatccaaaaccttcaacgcttctgaaagtctgattatcgggagcatctctcccttatagtggatcatctgtctgacgttctttttgtgttcctgatccagtggcaccctgataacctggaggatctgctggaccggaacgacataatacgatgtaccgctcctgataaccaatccgcgtagggttgcaagtctgatcgggagaatgagtgagaaagtagttcctttccccttttcagaggtaactagaacctctcctcccatacgggtgatggtatcttcgacgatggcaagaccaagaccccgtccggagaggtcagtgatcatcgggctggtggtaagacctgacttaaaaatcagccagattgcctcatcatcatcaatggcggttccttcttcatcggagagcagccctttttcaatagccgtctttttgattttttcccggtcaattcccctgccatcatcagagagggtaatttcaactttactaccagaatgagccgtaatttttatgcggatctggcctcgtggtggtttcccgttcgcctcccgttcatcaggatattcaatcccatgatcaacactattattgataagatgcatcatgggaactttcagcatgtccaggagacgacgatccatctctatctcgcccccctcggtcttcagatcaacttcttttccaagaccccgtgaactctcacggatctgtccggatatcggtataagaatgcttgaaacggggacaagaaccgcatcatggataagatctgcgatctcggtcgtgctggcttcaagagctgatcggtcaaggtcagtagcatgaatatgggcagcaaggtcatgctgcaggttggtaacaaattccctgtcatattccagaaaatcacagacccgttcaagaaataacaacagttcaggcggaagggaagtccggtttaacccatacatggcatccctgataagatgcatatcattaaacacaaggctatgattccatctccagagagaaaacctgcttatcatctcctcaagttcttgcatccggtgagtcagaaagagccgtgtcgagaggagattatcagatccgataatcaggcggtcaagtttttttgctgctatcctgacggtaccggaatcggatgctggcgggccatggtaggcatcactcccatattgtgcagaatgaagggctggttttacttcaagaaaagtactgggagcagcaaatacggccggatcaggattcaaaggaataaccggttttttctcttcactcccctgcctcattattgatggggtctgaaaaaaaggtccttcttcagtctgaacggaaaatacttcctcattcttttctgtcggttttcgttctgcaagtgatgcccgtagtttttggatgatatcaaccggctgtggacttttcttctctccatctgaaaggaagtttctgatactttttactgcatcatgaaagagatcaaattctgctgcagaggcaaaaaactcctctctcttcattaacgagaagatattctccagattcagacaaaccgattctatctcacgcagatttaccgcccgtgctgcacctttcagactgtgtgtctttctgaacacttcttctatgaggaatggttcaggatgatcctcagcctgctccagttttatcaacccgtcagttataccggtgagcagttcttctgcatcctcccggaatgttgccaggaggattgcataaaactcatcatctgaatctgtcatggaggaggttatacctggtactggagagttatcttcttaagtctgatacccagttcatgcagatcttctgctgtcttttctgctttatgggtgatttcaagattcttttgtgcagcattcctgatattttcaattgcttctgatatttgatccataccggctacttgatcctgtatggatgctgtaatctcgatcgcctcgtgtgaggagtctgcaattgaccttgtcaacacttctatggcttttcgtgcatcagttgtcagccggactgcatcagcgaccgtatttgaaccacgctcggctgataccacggtggatgaaacaccacgctggatatcggtcaggatagttctgattgttcctgttgcctgctttgactgctgggcaagattatgaatttcatgagcaaccacggcgaaccctttcccaaagtctccggcctttgctgcttcaatagacgcgttcacggcaagaaggttggactgctctgaaatgtcagtgacggttgcgataatctctccgatagcctggctctgctcggataatttcacaacattcatactgatcatgtccatctgtcgctgaatatgattcattccatcaaggatctcctgaaccgactgctgaccggtctctgaaacctctatggccttcatcgccttttctgacattgattttgtcttcaggttgacgagatcggtcttctttctgaccgtctctaccgtgtcagatgtctcattaacggtatttgccgtctgactgctagcagaagagagctgggatgtgacggtcagaatttcactggatgcaactgacagtactgatactccctcaaagagttcctcggttatcaatttcatgagtcgtgagagttcgataccgatggtgtttagtgcatcccgatatgccacaaattcccctgcaaccgggatcttctcatcaaatctcgcggtaaagtcacctgatgcataacagcctgcaagacgcatggcttcattaaccggttctgtgatcgtctcaagggttttattaaatccggcaataattctccggtaaccgcctcggaaggccttctcatcgccacgtatggagagatctccggcccgtgctgcatcggtaagttttatggtctctttatgcaggtgatcaaaggactcaaccagaagctgcagggatggacggatctggtccaattcatcgaccggcccggtgaactcctgaatatattcaccatttgcaatcttgacaatatttcctacaacatttttctgcaagtcatcggcaaattcatccatagtggtggccatgataccgatctcatcttttctcctgatgttcagtctggctgataaatgaccattcctgagctctttgatcatgacgacgacctgttgaaggggtcctgcaattgattgaccgaagaggatggcaatgactgcaccgatgactatggatgcgataacaatggcaaggatggtatttctgatagtgttaatcggcccatcaaaatctgacatttctgcccgcgatacaatataccagtcaaggggctcaaaataggtatatgcatcaaggattgttgttccattaacctgatggatgatggctccttcctttttctccatcatctccttgacatattccatgtccgaccagtttacattatcaagtgtcggatggacaaggaccattccattcccgtcaagaacatacatgtatccattcttgccgacgaccgtatcacggatactcttttttacgacatcaagggtctgttcttcttcagtcccgacaaataatactccgatgaccgtgccattccggtccctgattggttcatacgccgtcacatagttgactccgaacagatcacgtctgccataataggtttcaccctgctttaccgcaacttcatagacattatcagtaaggtgggtcccgacggcacgttccccatcagtccctttgacatttgtggatattctgactgcataggtgttattgtatacctgaaaaaccgttgccgccccgccgaccagatccctgaccccgtcaacaatttcaaaattatcattgacaacaaactcttttccgtttttgtcgataagggtcatattattgttgataatttcaggtgtccctttcgcgtaaaagttctgtcgcagcacattcaggtcactgttaaccttattccgcgtaagtttgtagacatcattggtccatcctttcatatcctggacctgtgtttcgagcaaagtttcaatctgctcgttaattacgttgacagaactggaatatgatatcagtcccagaagcaatgtagggataattgccagaaatagtgatattacaagaatttttgttccaaccttcatatccgaaaaaaactgaatcataatgcctccttcatgcggcggactcttccatgcttcatactgtacgatctttgagacgagtagagattacccgtaatgtgatctgtgtcaggtttccgtgtcatcgattatcatcctgggatccgtcaataatgcctgtacattcagtacatgaagggaatcgatcgttccacaaatgtagttctgccatgcagtttgttctttcctgactgtcctgacaatatccccggtcttgagtgtgccaataccggttatctgatctgccaggaggccgaaggtaagatttccgtcggtaagaacaataacccggttcagatcagtcagtcccttctcgggtatggagagcagagtcctgagatctacaagtgagatgatctcacccctgacagagcatatccctgctataaaatcaggtgtcccgggaaccggggtgatctctgatgtctggatcacctccctgatgtatttcatatccacagcaaactcctggtacatcaggttaaaccggatcacctcgattaccggaggccgtttcacctcttctttcggaagtgcaagttgctctgcacgctccctcagcacccggtcaatttcctggtaatcgcgcactgatgaaatatggggggtatcattgcctcccgtggggtcaataagaatgtcaataagccgtgtctggccaattaatccataatccaggaattcaataagatcaaaaatgactaccaggtctgatgtgatgatccgcatcccgggaatgattgtctgcagatgctcattcataaaccggtcttcaggttccagatccccaccctgaatgacatatgtctcatctacccagagggcaacgttttcaagtccttttctgacaatgatgaggttatctgaagggaggggagggcgctctttgaacccgaacagttcccgtatcgaatagacctctaatatctctccatgaaggttaatcgtgccggcttttccttttccattcctgttttctgtgttgatactaaccattctgatcataaaaatcgcatctgaaaacggtatcccgcacctgatatgcccgacagaaaagaacaggtaatgatccatggctgaccaactatacagattattcagcatttgtcttttttcattataatactgcagtatttgttgcctgcatatctgatctttgaaaaaccctttaattttattaaatgagataaaaatggaattttatctccttataggggaaaaagtcgagaaaattttaagataatcgggtgaccgatataataataatataataaaaacaatggaatgaatcagggatggggatgggtccggatacagtagttcatctttcggataccgatattgagataattgatatcctttctgacgttggtttgaagagtggggaagcacgggtgctggttgtgctctttaaggggtatgacctgacctcgcgtgagcttgagcggatatctgatctccggcagccagaagtcagtatcgcaataaatcagcttattaaacgaagctgggtgtatgttaccagtcatatcaccgagaaaaaagggcgtccggtcaaggtttacagtcttcagcgttcgattgatgagatccttgatcagatcaaaggtgagattgaaggagactaccgcagaaagattgaggttattgagcgggtcagagtgatggtccgtgaggcaaaagaaaccgaataactttcccttttcaattatctcctgtatcggggaacaatacattgatccggattaaccggatacccatttttttgcagatcataatacgatatatccggggagtttcttccaccagaaatatcagggactgatgtcataccatactgcatatatctggtgatcatctgtgaaaatggcgttctgggtagcatccatcattcttgttctgatcttttctgctggtgtggtcgctggcgaagatatgaccgaccggattcaatatgctgaatactggtatcagcagggagtttctgagttcctcttaaagcactatgaccgggcgctctatctgctggatactgctgtcgcccaggatccggatcttgccgatgcctggtactggcggggggtggttctcagtgctcttggtgatagtgcgggttcagctgaatccatagcaaaagcaaaagccatgaaccccatgatagatgatccctttcatcgtcgtgtcggacctcttgcagagctggttattactcctgttccaacaccccggactgtcagggatgaagaacagccacagatggtggagacaaagattgatctctccaagcaaccagatccgaccggacctgatatggttatgacttcatttacccccctggtcagggaaggaaatccacagcttgaggtgaaggccactgttgtaaaccagggataccggccatccacggactttttcattacgttctatgcgtcagatgatgcaaccatcacccgggatgacacgccaatcgggtattatcttattccgaacctgaagcaggatatggagaagaaacttatcggatactttccgatggagcggatgcagcctggaaccttttaccttggggccattgcagatccggcaaatgagataatggaggtttcagaggataataatgtgatagtttcagcctcaaaagtgaccattcctgatgtgaagagttcggcattcctggtcacaaccggttctgtgccatttgtgtcagaagagacaaacgaagatacacgatttaccattactcggccggatcttgtgatcagtaaggtaaccagccagcagtctgcagtacaggggggaaccctgaatgtcaacacgacggtgaaaaaccagggttcagcctctgcaggaccattcaggatctcgctttatctctcaccagatgccctgattactgaaaaggatcgtgagattggatatggggaggttacggatctcggggttgggatgctccgcgacggaaccgccattgcaaccattccggcagatctcatccccggcacgtattacctgggggtgatggtagattcagggaaagtcatatctgaagagaatgaagcaaataatgtcctctttgccgataagatggtaaagatctccgccgggacccagccggtcgtgacagagactccacaaccactcacacttccggatcttaccatccctgatatcagttcagatactgaaggaaccccgggcggagttatgaatgtctccacatcaatacgaaatgttggaacaggtgatgcaggttcctttattgtagagctttatctctccactgatgctgaactatctgatgaggatattctcttaggtatgggtgagataccagaactccctgcagggactcagtctgatgggaatgcaccaaccccgattccggtgaacatgactccgggaatatattacttcggtatcctggtggatggtgaggatgatgtcatcgaatcagatgaaaccaataatatgaggtttgcaaaaatcccggtaactatcaaataaaaccctcaacttttttatactattgagggggaaacactatgcagacgagtaacaatagtgtgggagttataatgacagatcaacttcgtgatattcttatacacatcctctctgacgatccaagtcccgatattccgggtactgacatacttccaggagagggtgaccgcgagctgttaacatcgttcgtacaaaaaagggccgttctccagaagaaaaagaacaggatggatgctatttttgctcatagtccccagccgatactcatcctgaacccagaggcacggataaccgaagtaaacccatcatttctccaaatcagcggattttctccagaagcatgtatcggaaaaccgatccagaccatagtgcctggatttgtccttcctggtcatggatataatgagagtaggagagattcagaaattttcactctggatttcccccatggaaggcgaatacttgagcagtatcctatcccggttcgagatgagtctggcactcttactgagataatccttgtctttaaagatatcactatccgggttcaggcagaacagaaggcagaggagatacgggaaaaactggcacatgattatggtgaacgtgtcaaggaacagaaggttttttactcggttgcatcacttatccaggaagatactctgtctgtaccggatgtgctcagcaaagtggcatttttaattcctcctggctggcagtacccggaagagaccgttgcacgcatcctgtatggtaatgaggtatatacaactcctgattttatcgaaaccccctggattcagcgggccctctttcagacccggcgggggacagagggcatcatcgaggtagcctacctgtcagaaaaggctccagaatatgaaggcccgttcctacttgaggagagaaatctcattaattcacttgccgagatgctcaagacctatattgaccgaaaggaaggtgagcaggaacttgagaaaaagatgcatgatcttggcgagcgtgtgaaagaacagcagcttttctacaaaacctcatcgcttatacaggacgattcaaagaagataaccgaagttttgcaggatgttgttctcctccttcctcccggctggcagtatcctgagatcaccggcggccggattcagtacggcgatactgcactggcaacccctaatttccgggaaagtccatggattcagacatcgtcatttattacccgtgccgggatgaccggaaagatagatgttgtctaccttgaagaaaaacctccggaatatgaggggccattcctcaaagaggagcgcaatctgataaattctcttgcagatatgctaaagacctatattgatcgcaaggagggagaacaggaactggaacgtaggatgatggagattgaggagctggaacacctgaataatacgatagtccagcagatcccaatgcctgtgctgcttattgatgagaaccagcagattctggtgacgaatgatgcatatatccgattaacgggatataccagggaagaactcctccatatgaccccccgtgatattaccgtccttgaatattcaggagaaggtttaaaggagttattatccacaatgaagcccacttttggtgagcttacatgcaaatttcctcttgggatcaggattcttgaacagtatggtatcccgatattctccaggtcaggattgcttgaaaattacctgatcgtatataatgatatcaccgagcgaaaacggcaggaagaagaggttcagaaattactgaccgattccagaaccatgtctgaaacactctcaaaaagtgctgaggatcttgaaaccggtatggcacggatggcagaaggagatctcagatatcgtgcaccggtcatggagcaggatcccctctcaaagataaaaaatgattataataccgctcttgctgccatctcgcttctgatagaagaacttgaaggttcaatatctctcctgaccggaacatcagagaaaacactttcgcagactgataatatcaagaaggcaatacgtgatattgcagatgacgtccagaattcaactgccggagcacgtgagcagatggaggagacaaggcggatatctgatgacatccgactcctttctgaacgtattagtcagattgttgatatcaccacacggctcatggaacttgcggcacaaacagccagccagggagtagaggccggacaaatagggggtgttgccagtgagaagatggagtcggtcgggaagataagtgcagataatatgaagcagattaccggactgaatgaacagatggcagagattgataagatagtcaggctcatttcagatatctccagtcagacaaaccttcttgcactcaatgcggcaatagaggccgcacgggccggtgaacatggcagggggtttgccgtggttgcccaggaagtaaaaaacctggctggtcagtcaaaattagcaaccacccagattgaagaacttatccggactatccagtcaaaatcggccgatacggttacctcaattgaagcagcttataaggagatccatgagggcattgcaagtgtgaataagacgattgatgttctttcctcaataacatctcatgtgaccgagatatctgatggtatcagccaggttatggttgcgacgaaggatgaagaggtactgatgaatcgtgtccaggaaggtatcggggtaatgaactcagagagtgagaagaatctggcacgtatggaagagatatcacaccgaatggatgagagcaggcatgccacggatgatattgcatcctcctcactggagatagcccgtctctctggaaatctaaaaaagcaggctgacaggtttttcctttaagaggagtacccttatattgaaccgggtgaaaccttcaggtatgaacattcgagtccttaccgggttatgtacccttctttctcttttcatcctggtacagatcgtatcagccgggccggctctgactgatgatgacacggcatttctttctgacattctcacctccggaatcccgatgttataccagactccggaagcgatgaatatcggggtttattatggacgggattccgcgattgccgacattgcatccaaaaagagtgaagcacttctttcttttaccgagaagattaaggggtatactttgagccctgaaacgacgaaaattcgtgactcctggcttattgctgctgataaactgaaagctgatctagaggagtatgggacacttatcccaggatgtggatcctgtgtggctgcaatgaatgagatgtatcctgatctgcttgcttccgcttcatcattccagaaagaattcatagcattttataagaaaaatcaggttactccctgattctcattctattcttttacataagacttcgattgcttcctgaaatgtcctgctgtcaggtcgcacgattacgaccgggatgtcaacgatccgctctatcagggttgcaagaatgggagcacagatgattccacctgctccttctttttctgcccggaccgctgcaacgatgcagtcttccatggtattggcagtatatcctttgattctgatctttctcccgttcatttcgatggtcccggccccaatttcatcaaggagaaattttgcagcgattatggcgatcatgtcctgttcatagggttccagtgcctgcacaatggcccggaccgttgataaccggggatcgcgttctcctgaggttatcttatacagggtcgctggtggaatccccgcaagttctgcaagttccttcaggctcatctgacggcggtcaagtgcctcttcaagggcagatttaaaatcttgtctgaagacggagcgggagaacatacttacaggtatgagttttctcctctatgactgttcaggtaggtcctttatatactcaataattctgatatctgttccagttcctgatgagtatctttttcacgtttcaggttgacttttgagagatttatgcccgggaagaatccgatagcagagaaaattcatgagctgactgaccgcgatcttacgtttatgcatgtatgcggaacgcatgaggccgctattgcacgtcatggaatccgaagccttcttccaaagaatctgaagattgtgatgggacccggatgtccggtctgtatcactccacagggagagatagatgcagcccttgagtttgcggaaaaagggtgcatcattgcgacatatggtgatctgctcagggtgcctggttcaaatgtttcactggaaagctctggagccgatgtccgtattgttcagggtgtgcataaggctgttgagatagcaaagaataccgataaagaagtggttttcatttcggtcggatttgaaacaaccgcaccaaccgttgcagcaatgcttctgacaaatcctccgaagaatttctccatattgagttgtcatcgcctggttccccccgcaatggagtggttgctatcccagggtgaggcagcactgcacggatttctccttcccggccacgtactgaccgttaccggtcttgagggttatcgaaggtttccggtcccccaggtggtagcgggttttgagcctgatgatattctgcttggtcttcttatgctggtacagcagatcagggaaggcgtcgcacgggtcgataatgcgtatccacgagcggtttctgatgagggaaatccgaaggccatggcggtgatgaatatggtctttgaaccatgtgatgttgagtggcggggattcccggttattcctcagtcaggactccggcttcgtgaagagttttctgcgtgggatgcccagaagaaatttgatgtaacgattaaaccgacgaagaaacaagccggatgtatctgtgataaaatcctccggggtattgcaactccggttgattgtaaactctttgataagacatgtacgccacggacaccggtcggtccgtgtatggtcagtcatgaaggagcgtgcaagatttggcaccattaccacattcggaaagtttaatttcgatattttaaccatgactcgcgtgtcatgatctctcttttgttttttgtgaactctcgatggacctctaacaccgagggggcagtaccggtaaatttactgcttaatttttgagcgcctgtctggggtgacgtatgagggcaggttcagatcagacgatcatgttactcacatggactgatcttagatgtaatgtcagttttccagagacgggctgatcaagcagttgttagaatttgaaaagtacacacctgaatagttagaatacggggcacagtctgtcgggtattattaaaatatgaacataattcaaccgtcacggaaaacaaggggtggctgctgtggaaaaaaatctcaataatatgaaatcttcatttattagagaataattaagactatatgatacattggagataatagattattatggcagtcaccgtatcgttgagcgaatcagactacaaattcgttcaaatactgaaagatcgtgacgatgcatcaactgatggcgaagttcttcaaaaatgcctcatagacgcaatcgatcctaatgaagctgaaatcatcgcagaaatcatgggtcaggcgaacgaaccggatgagcctattaatgaggagactatggagggaatccgccgggggcttgaagatgtgaagcagggaagataccggcctcttgatgagatttccaaagagatggggatctgattgcattatcatgtctctttctcttattaagcagagagcaatctaaaacaacttcagcgggatattgcgataagaatacgagataaaatcaaatggcttgagaaggtaaataatcccagaaaatatctgcggaaggttgaaggaattagtgacgttccaacgtatagataccgggtcggagactatcgggcgtttcttacttttgaagatgacaaactcattatcatcgttaacgaaatcggcaaacgggaaaatattttcacaaaatagttctctccccataataaatgttatgtattaatttattgaaataaattcgggcttttatctaattaacaagttggataaaaatttttggagttattcatattaatattcagagatatcagccaatgttccgcgtgttatatcaacggtagaaaatttgtctgatatggtggtagtcattcaatttttctctctaattatcgctgaaaaatcattgaaaaaccagagcctttatctgtgtttagtgagtatatagtaaggttgccccggtagggtagaggatatccttggagcctccggagctttagacctgggttcaagtcccagccggggcgtaaatattaaagttcaaattctctgatgaaacagagtggtttactttttctcttttctgatatctgttttcatgtgttgaaaatttctggtattgtcgtatggtcacgatgaccatgcagcacttgagaaaaatatcatttacacagaagcttcagccatgataagtatcgtctgaaaaaaataacgccttttaggtaccttttggtgaagttttttggtgagatgaaagaaaaatatcattccatcccttttgactgtctgtaatattttccctcttcagttattcaggcaacatagggaccaaacataagggaccatgcgaagagcatcgtcaagtagcaaaccaccaggggagatcaggataatcgaaaaaacagtggatactgaattgtatcacaaccgacatgacaaggataatgataatactaaccggaagaatggaaagccatacgttccatggaaactttgaaaaccttctctttatccgatactcggcagcaacgtgtgtcggattacagatggtttcttaatatttttcatgaatcattatagaggttgttgcacaactaaaatgttggttcctcaagagcataatttccattcggttggaaggttaattgacaatgaaatttatgggatttgcctcattatactatcggtttgaagttatgcaacagtctctataagccaatttttttacgaattaaattcttttaggtaagcggatgccaaatcatatgccctaatcaccgtctctttctcaatgtttgggacaccacatgacacaatatgaattgttttcgtacccggagtaatcttcgttccatccgagtcccggtagggatacactgcaataatctctttctcatctataaggattacctggttgctttgtaggttgataggtttctccatccctatccccagaaattcctcaccttcctgtgcaaatcgcatcgaaagctccccatggaggagatcagcatcaaaggctccaattggtacacctgtccggattgatgccagattatatgcatccacggcagtattgatagaagggagcggttttccggcaagaatccttcgtatcagggcttcagaagcaggcctggtcttcgtcgggtccactccgacgctccagaagaaatcccggtaagccctgaagagtggttcgtctttcacctgttccagagtgtatcgttcattcacttcggtgatgatcgtttgtttcaacatttccaggtttgcattgttcttttcaatagaaaccggcccgacatctccttcgacgacgaagagacccggaaaggtagtaatgatatcctcgtgaaaaatcatataatgtactgagccgggcaggataataaccagctcgtgtagcgaataagaaagatagtataatataattgaggatataaaataggattaatcatgcgatatatatcttcagcagagatcagatcaaatcctgccctgttatggaaagagggtgaagataaagagacaataattaccgtaaatggtaaacctaaagtgataacgctcacattcaatggtgatcctgaaaaggttctggatcttatcagaagactccgtgccgagcagtcaattgaacacatgtgggaaaaatctatacagtcaggtttgaatatgatgacacttcctgagataaatagtgagatcaataatgcaagaaaagaattaacaaatgaataaccttgtcatcatcgatacaaatgtcctagtatcaggtcttttaaacccgaatggaaaaccagcagtcattatccggatgatgataacaaatttccttcggatcgttcttgacaaccggatctttcaggagtaccgggttgttctttcaagaactaaatttcagttttctcctgatgacatagagcccctgctctcattttttaaaaccaacgggttgtggattctccctcctccaatgttgttacatcttccagatccttcagacctgccttttattgagttagctcatcatacccatgcaccggtaattacgggcaatagaaagcattttcctgatgatattatagttatgacaccgtctgaatttttacaacagaaaagcatgaataataccaaataaccttctatggcccaaattctttcaaatgattatcaaaagcagattcagaaattttctcataacaatactttttaataatcttgatttatgtatacctgaaaaatttatccgatgtcatgataatttatatgctttatcagttcaatacagacgaaaaacgccgcaaccagactgatgatgatacccagagaagggctgatggaggggtaaagtagaataatacctccccaatgaaggtatctgggagcagaaccgttgcaagggctgctattactgtcagaaggattacatacccggaaggccaggttgttttatagaatggtagttttgtcctgatagagaagaggaaaatgagttcggtgaggatactcccgataaatcagttcgtctgcaggacattgtctcgttcgtgcatgaaaaatgcaaagaacatgagatcaaatacggtaacgacaacaccaagcaacgttgtaaccagcattatctccctgacctcatactttctcggttttttgacctctgtagagtccaccgtatcggttgcgatagatatcataggaaaatctgacaacagattgaccaggagtatctgtatcgggagcatcgggagaaatgtgatgaacatggaaccgattgcaatcacgtaaaaaatggctaaggaaaaagtgcaacattgataggggcaaatcccacgatgattgctgcatcgatctgctccccgatcgcaaagacaatacatgcggtggccaagagcagatagataaacggagaggtgaatgccggattgcaatctcccattatctgacctgggtggccgatatctccttcaattcgtctctctgaaggattgctacggctttgttttctgacaggccttctgataacggggtgtgaaacttctcctgaatattttcaagagtgaatgatgcaaaggagaaaatatcctgtgttctctgtgtatcagggtcatgatttttcacagtatcccctggccaaatgaaaaatccggacacgttacgaacaatgatagatccctccttcatggttcgcatccggaaggaacgaaatccgactttctcatgaaaatcgggatcaagtaggttgacatgaaccattaattcgcataatctccttaccttcctcttgaacaattatctcagctcccctggacaaaagctgaataatctttgcgattccaactctctcaattttttctggaaacttgggtatcttaacagttttcactctaggaattccatcttcaaatatttcattattgatgagaagatgccaaacaatccgtaaaatcttacgagcaacagcaacaattgcttttttgtaaccctttctgggtaagagaccgttgaaatagtcattcaatttccctggtcttctaattgcagagtgtgctgcttcaataagagcccatcgaagatatttggaacgctgtttcgtgatgggtccagtgtaattggtatttgcagactggtaaacagatggggtaagtcctgcccatttggctaatttatctgcggttggaaaatcatggacatcacctatttctgccaacaaattagatccaattactattccaatccctggaactgacatcaaaatacgtaattcattctctttatccttgaggtaaaatttgattctttcctcgatccttttaatctcaacttggaggttgtcatatatttttaacatcgaatctatgaggaatatagctgaatcaggaatatactcaggaatctgctcaaaaaagacaggtgcaatctttcttgttttagcgggtaatgcttttacgatctcatcctgagtttttcccatgaaaaaaagaaatggtccatgtaatcctgatatatgatctcgtatcctggagagttcacctgttccctggtaatattttaatggagatgccagaactcgtggcttcacttatctttttcctttctaacgggtgtacccttctggttgatatcaactgtgaaatgactgaaaaaccctgagtatagatttaagaagaataagagttcagatgaaaaagagattgggggatataagcagtgttatgcacatcagacggttgcgatcggaaattccattcttctttgaaagccttgagagtttcccggagtaacaagccaggttgtactgtttgagtaactgtatcgctcaatggtgaagtcaggacagatttctgagagtattgccatgttagttccgacttccttggaagataagccaagctcttttgctatatatttggacttcaggaaacatcttccgttgtgaagctgtgttttcagatagttgataagggttatctggttttcattgtactttgtgctgaatctgctttttgttaacattttttacctctgttctgattaggggtggagcgttcagaatgcccagtttgtaggaggaaagcctgacatcctgccaggccatgggtgttttctgtctgttccggtgcgaattttgtgggagtagtaacgggcagatacccggtttgtctctccgttaatgagaagggttctgattattgcaatgtaggaggacatgcagaacgcaggtcacatcttctcatccggagagtgaagcacagatgatccagacctgaacgcccggaaatgttctatgcctgctcggtctccccgtgacatatcagtattgaatgaaacagtgtataagatctgtagataaaaccgtttaaaaacaatctgaaattattttcgtatgaaattattcagataaatgaagaaccatgaatcctgcgaatgaatccgggggaatccttacgttggtgtctgttgttactagtccggacagaagaaagtttatcgcaggttcatcgtctgcactgattcactcctggtgaaataactgaaatgaatagttgcaaccggttgcaactggtttttgagaagttttcgatgagaagataatatttctctgccggtactgatggtgggggcggtttacttcagtgaagaagaatccttatactgggagtctagaaatggtgtcgttgaagagaagaaaaatgccgacggtgaattgtcagatgtgtctcgacccttgcaagtacttcttattgtattaccaaaattgatttgtacaacagcctcatgtgtaattaaaaaatagcttttacaaaagggccggtgctatatatcttcatctgatttcgtctctatcaaggtcccctttttcaccagattttccagacagaacctgatattccacccacggttctgattcagtcctgtaataaaatatggacgatcacggccgtcaatgacaatttcaactccatccggattcatcgtaagttttgttatccgtgcattgaggaagacaaatgggtatgtgccgtctgattgaagtggaattatccgttctgatgagacaaccactgtcccccgatagatctcataatactcccattcggtctcttcaccagctttggcatgagagtaaatccgatctctcccccaggtcagagtaaaaagtttcccggtttttttctttttgaacacttctttctgatcataaattatcatggtgtcaatgtaatgaatcatctctcccggttttctgatctcccgaaggccaaccggtatttcagtacaccatcgtggtaataatccgggtttggtagtaaattcttttaaataccggggatagaaagtctcgaaaaagtaattagtatctgttggaatctgaaggagttctacaaaatatctgaccagtccgagtgtttctttttgaccgatgtcggtttttacttgaaaaaatctgaagaggagattgtatttttcctggtcagtcagagatattaaaaatgggatttcattagaactaatcttctccaaccggactgcttttttaaaaagatattcctcaacgaggcatttatctgattccatcttctgaaggcatgagtcacatacatgggtatgttgaaataattgcgattttagtttagcatttccacatacgggacattcgtgtccattatgagtctcttttaaaattcgctgcgatgtatagtaatctgaaagaatagtttcatatgaacgactttcatcttcagaaggttcattatgatgaggaatgtgcatgatatcagaatctggttttgtgatcggaccgatgatgacggatgaaccggatgcacctaccttcggaaaattatttcatccataggtaatcatcggacacatttcgtaaattattagtgtctgggtattatagataccacctatgggtatgcgtgatgaattgttctccaagtggatcgaagcgatgaaagaggtaaaatttccggtatcatccgtggatgaagtctatgccggattaccgaagggtgcagaaagcaatatttctgtcggcggacttgtcgtctgcaataccggagacctgtttggacggttcataaaacccaccgatttcccaatcgaatccgcccaggcccttgcaaaccttatactggatcgcgccggtctgtaatatggccgaataatcacgaatcaatcatggaaaaaaaattggaattcagctaaaaagggtttattaatcccgacgttccacaatccaggattcattgtcttccctgacaaaaagaaccggactgtgattaatcctcattggctgggggaactttcgaaaccggacttctcctgagtcaattgatcttccgtcaagtgaatatactgcaggaattcctgcatcatgaatcgcagaaatctctgcctgaccctgcagggttctgatctttccaacctgtatatatctcccgtctgatccacctgccgccaggcccacggctgcaagagatccgataatgcccccttttgtgccatcaagcccgatgagtcggactcctgtgtgtgatgccattgtaatcgcctggtcctgggtgaggacagtagattttgcttcttttccaaagagaatgagagctggtgtgacagactcatggtcagtcatacagactcccggatcactccccttcgctgcccgggattgaacaaattgtgctacctcttcaaaaagtgcatctcgttcttcatgaggaactgcatgaacatgaatgactgcagcactattatgtgacgtgtatggaatgtccgggtgaacatagagctggtgccgggtaatcccaagaagatggtatcgatgttcgagcagactgaacaaatccctggcaagtctgccggttcccgggctgtcaggcatatcggtatcatccagtgcaatatatacagtcatgttatatgtcctgtcacccggatgcgtgggtgataattcttcttacaggtacactgagtagggtatcattcttctgatttgaatcacgaaaaaatagtttagacaaggaaagaccattaatatgagttctgcaatatcaattggatatcacttgatatattcttattaactatgtttgtaaatgtaaataattttcatgttgcctgacacagtataggtgaggatgagaagtcagaatatggctcttgagatccatcgggaaccggaacattacaatccgatccactttccggactttttgggtttcttctcactcctcattttgtgacctttaatatttcatcaaacatggctgatccaatcagggatgcactctcttccggatgaagatcagacatgactgaaacaattttttgggtccccttgctggttgtcagtattcccacccgctcagctcgtgttaccagttcctgttcttccatcatggcaaagtacggtagtatatagtagtgaggtacctcgaggtactcggcaaggcgccgggtagttggaaacctgatatgaatcccttctttagaaaatgtgattgaaatcgcgttatcttcgaaaaggaaaatttttactgcagattcgaagaggccttcgattgagagcgatggcatataataagttttagggttcgagctataaagaatagaggaaagaaattagtgttttttcttctggtcatcagggacaggctcaagccagacaatttcagcgccgacttcttttgcaatcatttcaagttctatctttctgaaatgggttgcaacaacctggatctgtccaccggtaactgccacaatccgatacttcgggcttttaactcctgccccgaccttttgtctttcacgtacaaaaattttcatttttggtcacctcttggaaccaattgatatatgctcaagtgatataccagttggttttcaacaatttatctatatgatcttcacgtatttatatattgttgtggtgatccatgcacgagcgacatgaaatttttaacaaactccagggcgaaactctggttcgaaaaggattatttgaccggtataatgagcgcccgctcatgcgaattcttcctgaactgaatgtcatcaagatcggcggacatgggatcattgattatggccgcgatgttgttctccccctggtagatgagattggtgctctctcaaaggaacatcaggtgatgatcatcaccggaggaggagtccgcgtccggcatatcatggatatcgggcttgaccttggaatgccaaccggggtactcgcagaactgaccagtaagatctctgaacagaacgcaatgatgcttgcaacacttctcgcgccttacaaagcgaaacgaatacacaccagtgatcttctggagctcccgacacttcttggcatgggcgctctcccggttacgcatggaactcccccttatggtttgtatgaacacccttcagagcgcacgaatggtggtatccctccccaccggactgataccggtgcctttcttgcagcagaagtcctcggggcgaaaagctgtattcttgcaaagaatgtagacgggctctatgacaagcatcccctgaaatttcctgatgcagaactcattcctgatatttccgcaagtgaattgattgcaatggatatggaagatcttgttcttgaacgaaaactcgtcgaactgatgcttgagtgtcggaatgtcaaagaagttcagatagtgaacggacataaacccggaatgataaccagggcagtcaaaggcgaaaaggttggaaccattatccgtgctcagtaatagacacctggtgtgttacccaaatcgggactattcatagtccattttctgaacctgcgggtatgccggttcagccatcaggtgatgttgattgatgatttcatttttaattctaaacactcctataagcgtaaggaacaaatatctgatatggatatgctgctctataccggatacatcggggggatatgcacaacaattgcatttcttccccaggttgtcaagacatggaaaagcaggtcggcacatgacctctcctggggactcttattcctgcttcttatcggtgtctttctctggatgatttacggaatagtcagtgccgatattccggtcatgcttgcaaatggagtaacaagtgtattcatcgtctcaatcgtggggatgaaatggtggtttgatcaccggttggctgggaaagcaggtaaataactactgctgtctcgttttcagatgttcttttcggtatatcagtatccaggccagaatcagccctgcacaaaaccctatcgcaagaccaaacaggaccgctagtaccgcaataaggccggtaatccaataattatctgtttttagtccgtgctttgcaagttcaacggcaaccacaatgagaaggactccgaacatcccaacaggaagggcatcggtaatttccgggtctgcacagagtattcctataagaaaaagaagtattcccccaagtattaatgaaagcccgcccctggcaccaaaccggtaatgggccgccagccctcctgctccatgacacatgggaaatcctccgaatagtgatgctgacagactcatcatgccgaccgttttacagattttatccgggttcatctctcttttaaacaaatcatgtgccagaagagatgtcgcaagtattgcatttgtcagggtcagggggagctgaggaggaacaaaatgaattgttgcattaaaaaaatcttcaggtgatggaatctgaagattggggacaggaatggagatgaaggttggaaatcctgcactgaggaaagctacgataaagcctgaaataatgatggtcagcgcagagagatccggaatttttacaaatctcgtactaattaaaaatccggctacaatccctaccgatatgagtgcaaaaggtatatccgggagaataaatcccggaattgcgcttttaatgaaaatcagtgccaggcccagctgaactcccctgataaccggttcaggaataatctgtctgacacggtccatccaaccaaaaaacccgatgcacagacatatgatacccattacaatacccgacgctgctatcaggtgaggggtgacagactcagcaatggcaatggcaccgactgctttgagcggttcaaccgggatgggaattcgatagtagagccccgtaattatgtaccatgcagcagcccacagaagcataagggagatattcattccgcatgataccgaaacggcaaaaagaagtggaaggacagttccaaaattacctgccgaaccggccagctctgaaagaaaatatgaatatcggggaactgactgatcagagacaggcattatcgttctcttccggcatgatgtggactgacggagctttaaatgaaagcacaacctccacccctggtttcaggtccaattcacgaattgactgccaggttacctgaactgaaagggcaagttctccggattttacactgataaggctgataataccaaatggtcgcactgcatcgattgttccaaagagaacattccgggcacttgaccatcggtccgggccggtatgcaacgtgatctcttcgggccgtatggccatcctgatctgggttcctacggggatgtcaccaattgcatggatctcgattccatgtgacagaataactgacattccctcttcctttcttatgacttttccagggagaatgttccccatcccgataaattttgcaacgtcaacagaacagggacgggtaaatacatcaaaaatggtcccggactgaataaatcgtccattcatcatgaccgcgacccgatcagcaagccgttgcccctgcatgaggtcatgggtagacatgatgacagtcgtgccaagttccttattataatagcggatgagatcttcgataatatcggttgaaacaggatcaaggttggcagtaggctcatcaagaatcaggatatcaggttcggttaccattatcctggccaaagatatccgttgtttttctccaccggagagggtcgttgctttccggttttcataccctgaaagcccgatttcatccagcttctgcaggattttctcatttatcgcctcttttccaaaaccccggtaccaaagaccgatcgcgatgttatggtacaccgattccctgaaggcaataggattttgaaagaccataccgatgcgtcttcggaccgggtcagtctccgaaacatgggtgagggatttcccttctaacaggacctctcctgatgttggtttttgaagaagtccgagaattctcagcaatgtggtttttccctgtcctgaaggtccgatgattgcaaagatctctcctttcctgattgtttcagttacaccggtcaggacgggatttccatcaaattctttcgtgatatttctgatgtcaatcatctcgttcctacctgttctgtaccagtcccatgaagagattgataataagcgcaatggccagaagaataattccaagagccaatgaaagattaaaatttcccattgatgtctgcagggatattgcggtggtaagcactcgtgtatgacctttaatattaccaccaatcataattgctgtgccgacttcagaaatcgcccgtgaaaaacccacaataactgcagccatgatggcaaatcgcgcttcacgaagatgactttttaaaaactggaaccgtgatgctccaagtgatcggatggtatcggtaataatcgggtctatcgcctgaagtgctgcaattgtgaggccggccataatcgggatgataaggatggtttgaccaaatatcataccattcggtgtaaataaccattttaaatctccaagtggtccggatcttgaaagaagcatataacagaggagaccaacaatgaccgtaggaagtgcatacagagtttgtataacactaatcagtgccttttttccatgaaattccctgaaggtgatagctgctccaagcggtattgcaataatggtactgatcaataccgaagaaaaggttatatgcagagttctgattgttatgttcagcacttcaggatctgcggtcagtatgagatgaaatgcagtctcaataccggtaagcagatcgttcataataataattgttgtgaaaagaaaagaacggtgtggattatgccaccttgtcggtggtctcttccacggtcacgcccattacttctgcactaccccgtccggggttaaagtatggtaccccgttcttttcgactccataggtcgagaggatatcctggacttcatcactgatcatgaagttgatccacttctttgccatctcagtgttgacatccggacatttctcttcagatacacgcatgaccgcatagacattcaggaagttctcatcattttcaaccagtgggacaagtgagaggttgctctcgaaggttccccaggaggctgagtcagttaaggtgtacccctgaagttcgtctgtcatggtaagggttgggcccatacctgcgccagcttcacggtaccattctgaggagttgatctctgcatagtcatacccgccccatttccacaggagtttctcacgtgaatgggttccggaattatctccacgggatacgaaaacgacgcttggatcctctgcagttgccttctcaattgccatgaaggctgctgttccgttcagtccggctacctttgccgggtcattttccggtccgactaaaaggaagtagttgtacccgaagacacgacgatcgacaccgaatccttcatcaataaacttgtcttctgcaacacggtcgtgaaccatcacaatatctgcatcacagttttttgcaatttcaatagcctggccggttccaacagctacatgttctactgttgcaccggtctcttccttgaatttctcttcaagaagatcaagaagcttggttgcgtcaagactcgttgtggttgcgatgagaagacggtctgcactatgttctccgagattatcaaccttttctgcagatactgccccacagaaaagcattgcccccagcacaagagcaatgatcccaaacgataatttaccgatcatgcaatacgagatcgtcgtgtaataatatatatttgtttaattgtcctcttgagtaaaacaattgttcaatcaactgtaataccaattgattttaatgtcgggtgacagaaaataccgaataattctccatatattcttcatattttcccgctcattatgaattcatgggtatggatcattcctgctcaatgaataaatttttattattccttgttgactggtatttcataccgaaaaagacatcctgttaagaggtattatgagatactctggaaaaaaattcatgcgttctattgatattataaatttctttaaattatagtatgggagatccagtctgtttagctgcatatgaacccgatcccattgtatccaaaataccccttctctctgcattggagcgcgattattttctcaaaccatgatcccatggtccgcacctatagtaatcatgctttcagttttacggctcttctttcaaatggcccgtttgttctaactgtgaatcagactgacccttttgaaaaaactccacttactctctcaatatggtcagataaagcggtacgtgcgcaagatacctgtgaagcatcagacctcatcacctggtattttgccttaaatgataatcttatggattttctggatgccatatgttctgatccggttatgaaaagtcttgctcaccggctggatggccttcgtagtccggctacacctaccgtatttgaagcactcatagattcggttatagaacaacagatctccctgtctgttgcacgctctcttgagtaccggtttatcagacaatttgggagaacctgctttgtgaatggagatctgcattattgttatcctcttccagaagatcttgccggactagaaccatcagactttcgaagatgtggatttacgtcgcgtaaaggtgaatatatccgggatatctcaaggagtatcgagaaaggaaaccttgatctggaatcattcaaaaaagtcagagacaatgctgatatcgttgaggctctttgtcagattcgagggattggcagatggactgctgaactgacgatgcttcggggacttcaccggatggatgcatttcctgcagatgacatcgctcttcgccggatgatatcccgttggtatcataatggtaaaaaaatatctgcatctgaagctgtaaaaactgctgaacagtggggcgaatataaaggactcgcgtcattttacctggaagttgccgagtattgcggtattattcctggtgtccggtctatctgagaacactctttcaatatccgaagagacgaaatgatatcatggatgtgaaaacttcaaacatcatcaccatggtagccggtgtcatattcgttctcctcggaataaataacatcatgcagggaacagcctggtggcgttatatcacttttgttatcggtattattatccttgctctcggagcctatggatataaaacaggaaagaggttttaacttccctcttcctttgaaaaatgccaggactctccgtttttacagatgtctttcttccagatagggacgaatgctttaatctgctctaatatccatgaacaggctgcaaatccttcctgccggtgagatacaccaacgacgatgaccaatatcgtctcggtcagttccatccgtccgacccggtgcacgatatcaacggtattcaggtgataatcggcggttgcctgctttgctatcgtattcaggtcagataatgcaacctcttcacacacatcaaggtcaagtgcttctatgccatcatccctgaccgttccgataaaggtaacaatccctccggtctcgggtttctttgctgattcaatgaatttgtacggatcaatcgggtcacgggtaatcgcaatcatcgttatcctcctgaaaccggcgggaagagaatgatcagatcaccatctgcgagtggaactgattctgcctccatcggtgaaatacgggtatcatgatgcatgatcataacataacttctgatattgtgtgcagtatcaacgagcagctcagcatccggaccatctcctgcaagagctctgaccgcatcatgaatcgttgatccttccggaaggtcaagggtttgttcttctccaaatgcatccctgaatcgtgcataacaccgaatcgtaaccttcattcattatctcctttataagaacataccggacagttcttccgcttaccaatcgttaaaaattcacttctacccgcctgtccgtcccagaggaataaccttcctgatatcatagacccggttccggtcaggtattttattgcctccattgcctgtatggatccaataactcctgcaacggcgccaataaccggaactttcccgccaggaggtgcagcggggataaggcaggaaaggcagggggactgaccggggaggatgctcgtcatctggcctgaaaatccttctatcgctccatgaataaatggaatatctgcgttccaggctgattcatgcagaatgaaccgtgtttcatagttatccagggcatcaatgaccacatctgcgtctgcaacaagccgatctgctgatccctcatcaatccgcccaggatatgcaacaaccgatgtatccggtgcgaggctgccaagagttgcctcagctgaatataccttctggagaccgacagatgcagcggcgtgcagaaactgccggttcaggtttgactcctgaatacgatcatcatcgacaataatcagttctccaatacctgccagggcaagataggttgctgcaggtgatccaagtcctcctgccccggcaatgaggattgtggaattttccagtttcttctgtccctcatggccgataagaggcaattgcctctcaaatcggctggatagatatgatggcggtatttttttcatgaacaaaacctgtctctgatgtacgcaagggtttcttttgcgtcttcctgcttttgatcaatccgatgttctctgatccatttcatcatctcgtctgtccggtctggatcaaaggtgcattctttcaggatgcgtggccatgaccgatccggataccagagtgactgtccggttctcaggatctgttctgcttcatcttccgtgaaaaatccagttctgaccccatgccggagggtgatccggatatttaccagcgcctcagaaaaggccatgtttgttgtggggtcacatatcagggccacttcatcatctgattcgatctccccgtcccggtacattctgaagatctcaccaattccaatcatgccaaatggttcaagttctgcggcacggagcgcgcccatgcttgaggcaccgatgacggtaattccatgtttcatcacttcaaggacttcccggtgaccaacggcggcatcctcaaagaacactccatcaatgattccaaccactctgggtcttatatgtatgatctcaaggagatcaacccgtcttaccggtggacggtattcggctgcaaggatcctcagagcttcaggaatcgacaggcttggtcccaggaatataattacgtcgtgcacgtctacaccgttctccgatacgttcgggatccattgcatagtgttcaagtccaggcacaattactctgacaaccggcaccccaatctccggtctggtcaggtcatgtacgatcacccggtcaagtcctgctgctttcaagcggtcaagaacgatgtgaatgtcatccagaaagtcatcggtatggtatgatggcatatctttgtatgcgatttccgcttcggtggtaaaccattttttattcaatcgcttggcgcggtcgtatccgacttttgagaggaaatgagttgtttttgtatcttcccgtgctccatggatctgtgtggccctgctctgggctacttctgtaagggctctgagaattgcaatctcactgcagagatgtgatcccattccgatgcacaggagcgtcggatcgcgaagctggagatcatctgatactgccgcgacggtcgggattccaaggtcacttgtgatatcgcgcaaaattacatctaccccggcctctttaaacttgtcaagaagttcacgggcaaccgggtgggtcacgtctgttatcgccggacctgcattctgtgatgcttctaccaatgaccaggcgtcccgctctataagttcacacaggctgtgaaagactgcttcttcataggtattgcctgatgcgattccgtttgtactggtcctgaataacttccccatgatccggggtaccggatgaaagactgcatgtgcaggaacccaaacctcttcgttgcggaggatatcatatccctgccaccagggaataggccattccggttctgcatattcgggaagaatgagagtatctggtcgtattgcattcttctccatacgaatctggtcataggtcatggtctgcgggctgcggtcatggacctctgctgaatatcgttcaagaccttccataattgccgatactcttgcagcgatgggggttgctcctttcccattatataccgttatggcgccttcggcagcaaccggacgaatacaggaaaaaacagggatgcctattctgtcaagaccggtgatatcagcaaccctggtaattccggccggcccggtgaggtcatggactgcttcataagtctcttctggagatctggtccgatgagtctccttttggtagagttttttgcaggacgagagtatcatgtgctcatatacgtttatattgggatcgtaaagagtaacatggttgcatgctcagaggtctggttcttctccagataaaaatgaacagatttatacgaatgaaatcataacactccaacgagggatctcgatggacgttttcaacacctttgtccgggatttaaagaaactcccggcagaagaacgggacaagatcattgaggaaaaaaagacaaaatgcatctgtccgacctgtccgagttataataaatgcgcaattgtggagcgcgaaaaactcttctgtatgatcggtcagagttttctctgcatatcatttgaagagggatgtaagtgtgaggattgcccgattgctaaagaatatgggcttgaatacaagtatttctgtacacgcggggacgaaaaaggtcagcgataccttaattcagtctggggttctaccctggaataaccctctctccttgtattcttattattgttccagctggtgattctccagaattgggaattctgatgatctgaagagttctaccagattttctcctgatccattacatgcttcggtaatcacattcctgacctcattccacatatccttagcaacatctcctggaaccggagtcagaccgtgggcaagaatcgaatcattcctgatcatgatgtattgctggagatcagagtaccaccgatcagctcctttcataccaaggtcttctaaaaggaggaatttataccgaagtcctatcctgatgataccattccggtcagactttctggcatatgttgaaatatcctgttttcgaagcatttttttgagatcagcaaaccggatcttctcttcattgtcatcaatcccgtaactgagcagtaacacctgggagatgagttcaacaacccggtacagccgtgcaagtgcgtcatcgtaccgctcaccatcgatccgtctcttcgcgttgtggagaaggtcaatcagcatgtaaatatatttctgttgtctgactcgaagtcgttctttcctatttaatatcgtatcatccatccggtcaagttccagaagttttttcagaaatttccggttctgagggatcaggatatcaagatctggcacatgttcaaggtatttataagccttttcatagtccatcttgtcccagtgccagtatccattaaaaagtgtgtaatagatatcccgttcaggcagactggtaatcccttccaaaagtctgagagagctgccaaaatgattttgattaaacgcataaattgcccggtgcagctggagccggtcatatgcagcaaagagcaccatctccctgatcctctctgttccggggatgatcattcctcctgacttctcgccggtcacatgagaaacagggtttctggtcaggaatgagacaatttcagcagccatgatcatctctctggttccggatgaagcttctatcacgacttcttcttcatgatacagagaggcaacaccatagatcagttcaaaacatccggtaaaatcgttcggatcagagatcatgcagattgagaatggaggaggtgaaatcccaaattgatcggtgagtgcctggtgtactggttcaatggttccttcacttttttctgaacaaaaatatatgacccgtgctggacggtatgaatgtattgcaaaactgcaggatctgacaagccgggacagggcatcctcatcggatgtaccaataccggtcccgagtgtcatgagaagaagcataggatttatttcagcacatttatgatatctttcttctgatcggttacacagaaatttatcttgatacaggtcctatgagttgatatgtcaacacgtgcaggattcttacttggtcttatgatggtctgccttgtctgtatatcatctgcagcagcagctccggcagctgacggggtcatcagtaaaggggagtatgaacatgcggagacatttgataatgggaattaccagctcttctggacgatttttgatgaccgtatctatgtcggtcttcaggggaagacaaccggatgggtaggtatcgggctgaaaccaactcaaatgatgaaggatgcagatattattcttgcaggtattgcagatgaggaggtgtactgggttgattcattctctaccggaaatttcggaccacacccggcagatactgaacttggcggtactgatgatattgtaaatctctcagtgaccgaagaagaaggtgtgaccattgttgagtttgaacgagcacttgataccggtgatgcatatgatgcagtcctttctccaggggacgaggtatccttcatctgggcaatggcaactgacgatgacccggcatttaaacacgatacccccaagggaaagggtactgttactttgtaacctcaggtatctccattttttatataatccacaaatgctgcaataaatgagaacaagagcagcgtcatccccataaggctgataatctgccatgttccggtcatctgtggtccgtgggtgagaagattcattccataactgatgatccagaatacaaggctgatatccagaaggagtaaataccgaagtcgtggcttaccggttatgatatataagataatactggcattgagcatgataacgccgagtaccagtaacgcagcttcagctcccatctgttccggcatcagtgtctcctgatatacaggtaaatagtgctgtaatgacttgaattaaacggtcagaaaaaaaggattagagtcctgagtctgcatatgcttcatagcaggtaagaaccagcattccaaatccgaggaatacagatacaacccagaagatgaatccgatataggggataaagaacaatgcattcagtacaataaatccgacaacgaatccccagattaaactgacctcttttttggcaagctgttgtatccattcaccaaccagggctccggtgagaatattcgccagcataagtcccaggagtatcagaaggaagagaaagaatgcaaggggtatgccgataatggttatcagaagaataacacagagtatacatccgattaaaagccctgcaatcccggcaactaatgagatgatggtcttttctttcccggttttaacaagggaggtataaaaggcggggcagagttttacaaagatgatgcccaggattaaaaacccaaagaagcagaggatcatcgcaaaggtaatgaatgcttgaattatatttccaatttctttcatgctaaatccgcaatccccgttctgctcgtcctctacagtcagatttccaagaatccttgcctgggtagtgtaccctgaagcactgatgatagcatcttttgagatgactgagtttttcccaagaacaaccgttcctccggtggcagcgatattttcagcatttcctgacatggttatcgatccaccaaaggccatgaccttcccgccgacgtccccattgatgtcaatgtttccaccaaaaacaataagatcagtcccgatgggtgcattcacctgaatggtggcaccggctgcaatgagattcttctcaaccggttcgttgacaatcagtgttcccccggcccaggtaatacttttcacaggagcattgacgatcattgacccgcctgacgcaaccaggtcgtcatcaatcggttcattaatgacaatattatctccggatcttgtgtcaaaggcagtaaccggagaaatgatgagccctgcagtaatgatgagggctatgaggatcataatcttatgtgccatcaggtttgtcatgtgtataacctcttctcgtttttattttcagcagaattaaaaaaaagtatctgtctgattattcctgtgctgggaccgcggctttcatatacatgccaaagtattctgtaaaccagtctgccttatcaagtgctgcaatttcaggtagtcctgcccagcggtactcaacatgctccttactgatggaaaggccgccggagaggatacttccaaccataacaaggttgaccacccggtattcattagtctcttgcatggcagtccctgcagcggtgtggatcgccacggtaaatccggtctctttcagaatttctcgctttaatgcttcatcaaatacttcacccgtatcaatttttcccccggggagttcccatttccctggatttgtctttgactggggagatcgtctcaggaccaggatatgaccgtgctgatcaaataatatcagcctgacacagagtgcgaatggttttactgtcatataaaaatgtctacctgtatcctgaaaaggattaggaaccctcacgaaatttaatcaaagaccggaaaatgattaactataccggtgcgagaatgtatgtgaatatctttctcattctggcatatccaaaccctcatagtttcaatcacgccatagcagacgttgcaaaccgtgctctcttaaatgcgggtcatacggtcttgtttcatgatctgtatcaggaaggttttgatcctgtccttacatcagatgagatcccgcgtgacggttctctttctcatgaagtttttattcattgtgatgagattgcaatggcggatggtatcattgtggtccatccgaactggtggggaatgccccctgctataatgaaagggtggattgatcgggttatcaggccgggtgttgcataccggttcctcgaaggagataatggagagggcgttccggttggtcttctgcaagcacgagcggcaattgtattcaatacagcgaatactccggaacaccgggaaaatgaagtatttggtgatccgctggaacaaatatggaaggactgtgtgtttggtctgtgtggtgttaccaatttttggcgggatatcttccgggtcgtggttaccagcgatgatattcagcgaaaaaagtggctggaccaggttcatgaccgggttatgcaggtttttccgggggtgtaaattatttcttcttcagccaggatccaagcattcccctgacaatctcttttcctatctgtgttccgatatgagtggcagtcctgacggcaatggtgcttacaacatccccgacatcttttgtattttttcttcgagtgggagacggtgtagtggttttcggttttgcctgggttcgtaccggtggcagaggtttttgagcctcactctctatctgccgttttgttaactcttccgctgcagaatgtcggtttatcatcatttcatacttgccaaacaatggcgatgaccgaatctctgcctgaatatctgctaccggaagaggagaaagactgctatggggtggatagacaaaggcccggtcaacaggggtcgggactcctgccctgtcaagaacagatatcagggcctcccctattcccaattcaccaattactttttcagtgtcaatcttcgggttctgtctgaacgattttgcagcggttttcactgcccgcatctctccgggtgtcgtcgcccgaagtgcatgctgaacacggtttcccagctgaccaagaacatcttccggtatgtcgccaggattctgagtaataaagtatactcccacgccctttgacctgataagtcggacaatctggacgatcttctcttcaagtgcttttggcgtatcagaaaagagcaggtgtgcttcatcaaagaagagaaggaatttaggtttttccatatcgcccacttcaggcagggaatcatagagttcggagagcagccagagtaaaaaggttgaatagatctttggtgccttcatcagagctgcagcagagagaatgtttatagtcccctttccgtccctgacttccataatgtcctcaagcatgagggacggttcaccaaagaagagatctcccccctgctcttcgagggtaagaattgcccgttggatggccccgagcgatgcaggagtcatgtttccgtattttccttttatttcagcggtattttcgagggcgaaggtgatgagcgagataagatcggcaatgtcaatgaggagtaattgttgatcatcggcgtaccgaaagagcattgataaaatacctgcctgggtgtcgttcaggcccagaatccgggataggagcagagggcccatctctgatattgtagtccggaccggatgcccctcctttccatacaggtcccagaatctgaccggatatccttcatatgagaagtctttcagacccaataatgcagtacgttcctcaatctttttgttcccaccacccggtctgcacattccggagaggtcacctttgatatctggtaataaaaccgggatccccatggagctaaattgttctaccagcaccctgagagtaacggtcttgccggttccggtcgatccggcgataagaccatgacggtttgccatggagggttcgatgaagatatctgtctcaccttttgctactggtgaggaaatgggaactgccatacgtgaatatttggtagtcatgtcttttgaggttgttgcatgaatcaattttagcgatacaatcagggaaaaatatcgctatgaattatagacataagagtgtgaactggtctcattctactcataataatcatttgtgtaacagcctcatgtgctgtaatgcatgtcttatcacgtaaaaaaataaggataagatatatttcgttatattatcagcattcggatttttgtgatgatttcaggaatttcttaaagatctccccggtgaagaataacacaactccaggaataagacacagtagccattgatctgcagtcagtccgacggtatggaatattgtctgaaagagcctggtttccgttatcagtatggtcccgatgattacccaaaggtatgcatataaaagcctgacattagagaaggtggatatatgaaatgccgtatcatgggggaaacgaaggttgagagcaacaaaaatattcatgagtgagagcgatacgagccccatggtctgaccaatgcccggagattcatacactatctgaccaatctggtacatgatgagcgttgcagcagccatacctgctccgataacaaataacctgacatacatcctgagtgaaatgatcggttcatcagaccgtctcggtttccgggccataataccgggtgatgcaatatccattcccagtgcagccccaatcggagctaccgtgagtatatgaatccagaggacctgtccaggggtaaaaagagcagttccggctattgcaaatactgacgatccaaggaaggcaaggataaacatgaacaggttcgcgatctggatccgtaaaaatttctgcaggttatcgtaaattttcctcccttcttcaatagcagccacaatggttgcaaagttatcatcggtcaggatcatccgggcagccccttttgctacatcagtcccggtaacccccatggcaatgccgatatccgctgcttttaaagccggggcatcattgactccgtccccagtcatcgcaacgatattccctgctcttttcagaacctgtacaagtctgactttgtgctccggagcaactcttgcaataacaccgatatcatcgatctgctcgagagcctcctcatcactcatcgcagcaaattcagcaccggtgatggcacgtccttcaatgccgagttcacgtccgattgcggcagcagtcacggcatggtcaccggtgatcatccgaacccggataccagcagcggttgcctttgcaatagcctctttcgcttcagccctgggaggatccacttctccgacaaatgaactgatcgtcaaatcctgcatcaggggcatgagatctgcttttgaatcaaaggttgcaggatcaaagtcttttctggcaaaagcgagaacacgaagaccttcctgtgcgattcgttcattctcacccagaattttagtccgatcttcttcggtgagttttttcgaagatccatcagccaaaagaccgaaggaggatcgggagaggataacatccggagcacctttgacataggcccgtatgattgcccggccatctgcatctttcatctcatggaatgttgccatgaatttatagtctgaatcaaaagggatacttgcaattctgggataattcttccgaaactcctggacctgtattcctcctttttctgcaagagcatacaatgccccttcggttggatctcctatgacctgcccgtccctgatatccgtgtcaatgcatagagcacagggaaagagcacatgatccagattctcgtctgcatccccttccgttcgtttaattattccttcaaaactgtatccttcacctgagacctggtaccggtgctgaacggttgagataaccctgaccgtcatctggttcatggtcagcgtcccggttttatcggaattgatagccgatgtggatccaagggtctctacagcaggaagactcttgatgattgcatttttatttgccattgcaacggtgcccatggcgaggatactgatgacaacagcaggtaacgcatcaggaatggagccaattgcaagcgaaacgccgatattaaagagtttatcaaatgattcaccctgcgttagaccaagaatgacaatactgagaaatgcaagtactgccattccgatgataaagagggtaacccgatctatctgaacggtaagaggtgtcttctctgctttttgttcctgaagcatcgttgcaatatgacctacttcagagttcatcccggtatcagtgaccaggatctcaccatgacctcttgtcacattggtgttcatataggccatgttgaaacggtctcccagaggcaggtcgggtttttctatagtatcagaggttttctcgacaggcgtgctctcaccggtcagggctgattcttcaatctgcaggtttgctgccagaattatccgtccgtcagcaggaacccggtccccggcatcgacaatgacaatatctcccgggacaatctcctctgcttcaacctgcgtgatctctccatcccgtctcacttttgcaacggtcttcatcatcttatttaatgcagcaacacttgcggcagcttttgcttcctgacgataacccaaagaggcattgaaaacagtgaggatgagcagaaggagaaatgtgtggtactcctgaatgtacagacttacaaacgctgcaatgaccagcactatctgcatataggatttgtactgctctaaaaacctgataactgtagatttttccttctcttcctgaagaatatttttaccgtattttttcaaccggtcggttacttcagatgatttcagccctgattcctgtgaagtgcccaaaaaatccaccgtttcgttggtgctgactgcataccataatttcttcaattcgggcttttcatcctcttttagaataatttctaccattatactccccttttatcttcaaccatccaatgatatgcggacatcggtcaaggatggaattgatatgctggatgataaaacccaatagaagacccatctatatattcattttgaaatgatcagcagtgggatatatcagagttggtgaaatctgtatgcatggcattgttgaacggcagacccgctcttcagttttgattggctaatttttaacatttttcctattctatgtaggatcacccctgtattgcattatttttatcctataactctgcaattgagtgcgatccctataatgcagaagtattgtataatcgtgaagcgaccatgaaaaagaacggagcgattgaagaagggtttgtgatatccggaagggtatttcacttgcaatgggtgagatataacaatttttataattttgaaatcatccaatttttaaaaagagatattctttattctcttcagattcttctacccggacgcagatggtgatgcccctttcttcgaagaacgggacgaatagggataattttacactttgtctccccaagctgcgtatacatggtggtatcccgatgcgcatcaggagaaattcctgaagctgagcgattcaggaatattttgagtgattcaagtgtccgtttcacttctgccttgatatcctgatctcgttcaatcctggcccgctcctcaagttcggggattgcctccttccacttcagcttctttattgtttttaatgaaaaaatccggtatttccgaagagggtgatggagatatcgtatcatcagttcagcatactgcttctctgttaagaacttctcggcaatcccacatgacggacagtttttctggtaaaccgggcttacatatccgcatgccacgcagtaataggcattaacctcttctttttccatgtatgtgttcttttctgtatgggagattattcaggataatgtatcggctaatgtattaggcactattcccgaatcatagtcagcatcattttaaatctggtcactgcccggactgcatgaggggcatgtgccgggaatattatcgtctcaccttctttcaaccggaaattttcatcgcttagagttacttcacattcaccatcaagaacggtgagaaccgcgtcatatggagcggtatgctccgagatttcttcaccagcatcaaaagagaagagggttatcgatcctgcttttgatacgaccaccatgcggctcgcaatcgtccggtcctgatatgcaatgatatcttttaatttgatgacttttccaagcagttcttcacggtttttatcggtcatgatgagaaatctcctattctgacaataggtaatgatcaggtatgcttgtttcgaatgggtttagaggtataagaaaacctgggtttttgatggataatgtatctgatgatgaattgaggaatataagattataaaaataaagcaattataaatcatactctaacgtgttgccatatacattatccggggacctgatcctttcttctcgataagtccgagattttcaagtttatcaattcttttgagtattgtattttttgaaacattgagtcttacagcaatttccccgcttttggtaggaacctgtaccagtttaaggatttgattgtccatttcgtcaagtaaagatgtgatatcttttctgaatatgacggtaaatgaagagggcgaagccttaaattcaacagagcagaatggatgacttgagacttcctcttctatcatttttattccaaatccatatctctcaatgtaccctgaatcaaataacaaatttgataatgatggatttcgggggatatgttcaggatcagatatttcaactcctggcataagggaaccgggattttttatctccaaccgatcaggatatacaagtatcttcacatccgcactaatggtataatttctatgagccacggcgttaatcaatgcttctcgaatagcacgtggagggtattcctcaacttttacccttcttgttccggaaacgatatccagtctttttaattctcgaatgagacctttatatgcttcttcaatcactttccatacaggtccctcgtattcttcactccatatcggacctccttcattcataccaactttcctaattctggctgatgaaatatgttcagtagcgtcagtaaaaaaaagtattcctgcatttgttaatttatcgtcgttttgagcaccggcactacgtaaatatctgtcacggtttcctttagcgatagttttccctcttgtttcctcaattcttttaaagaaccagtcgatatattcaggtctggcctccttttttgtgagcatcggaatctcatcccagtggatagctcccatctctgaggaaagcataatgatctcctgaagagaaaggggtctgactcctgtccctgctctgaaatatacgactcctccaattgagcagagtgtggaacttttatcaacatcgaccacaaggatatccttcccatctatggaaattttctgcgtttttatttttggtggtgggattatcgattggatggaactggttatcttttcaattgcttcttttgcctgtgtgccgattatctttcctgagtctgatattcctatcaatatctttcctccatcagaattcgcaaaagcagcaatttcatgatgaacatttttccctattgtctctttaaattctaataattcagactctccggattttatcaaataaataagttcttcaatatccatatgtatcgttcaaatctaatacgagaaaaaggtgacgataaaggggttactgttcaatttttataatgaacgatctgaacagtagaacaaaaaattttcatgtgcaaataatcgctaaattttaatgatcgctcatatttgttacaataatttttttgggtactctttatcgttcaataatttcatctgaattctgaacgatacgctatctactgttcagttttttccgtgaacagtatgaacagtaatgaaaggaacgatacacggtatcttatatcaattattacacgtatagaaaaagtcaggaaatagggacataaggcataggaagaatttgtcgcctggcactaacaaatatggatcacaagtggcttttgccgtacttcacctattaaacgccctcagccaggcggtgccataaaatgtaccgtttccgggttgtcccgtggatcaccctatgagacctcatcgtatcacccggggacctatggaaacgaggagaggcactacaaatatattggcatttagaggctataacctcttccttgaatccagagtctgatgcccgagtaatcttcagacaaatcaggcttgaaaaactctccggaatcaaataccacagttccaccaaggattgtcttttctggaaatactgccgtcattccttcatacggtgaccatcccgcagcactatgaagattgtccgctgatatgcgggtcagggtatctggatatattgcaaagtccgcccgatctccgggtgagaaacccgcttttgtgatcccaagaatttccgatggcctgaaggatgtcttggcgatgacatctgcaatgcttaccttcttctcaagaacccggcccatgagcagaggaatcatcgtctcaactccgggaatacctgaaggagcatgctcaaactcctttcctttctctgctctcgtgtgaggtgcatgatcagatccgatgatgtcaatctgatcccagcaggagaataactcccgccggactttttcagaacggagcggaggatttacctttccctgtgcatcttccgggtcaaataactcataactgagaaagagatgatggggggtaacctcacgggacgctcccccgccaggaatggcccggatggcatcagccgaagagaggtgacagaaatgcaggttacaaccatgggtattcatagtcagcacatcctgaattgcccgaacttcaccgctgactgaacggagatgatcatgatcggctagtgtcctgtccggcccttctgtcacctgttcggcatggatagtcatgagcccatcccatccggcaacctgctccatggtataccggagaacagaggaagatacagcctcaccataacttgaagggccggcaaatgtctcaccaaaggcaaaaatccccgccctccacattccaataagatctgcatcactggtaaccccgccgtttatcgcaaatcgtgtatatgcctgtgactcggctaacatcacccggtcacgtatcaggtcagacgttgtaagaggcgggatggtatttggctgatccacaacaaccgtaaccccgccggctattgcactttttgtcccgctttcccaggtttccttcgctttttgcggcccgtccctcatatggacatgcaggtcggtccctgccggaagaacgaatttttcccggcaggaaatctccagatcaccctttcctgctgcaccagtatgcataacctgcccatttgagatggtaatatccgctacccgcccgcctggaatgagtacatccctgagtaccacgatctcttgtcccttctccaacatcgctcctcacatattacctgtatgaaatgattactctgaccggttcttccatcgctggtagacccagtaccctacaccaccaagaatgataaggggcagcagtgtcaggatggctataaagagccagactacagtatcgacaaacccggcaatcccgtcactgataactaccggaagtgaataccctcccggtgcctcaacctgtgcaggttctgataagctgacggttatggtagagaaggatgttatgctgtccaagtacttcattctccccacaatccggtcaagttgcacctgaacacgttcgatctccttttgaacatcgagaatctcagatacattctgtcctttttccagcaaccggttgtattgggctaactgatgagtcagcgaatcgcgttgcgctgcaagatcaacatactcttcagttacatcatcagcttgcactgaacttgacagaactcttcctatggaagatatttctgcaagggcatggtcaaaacgctcagcagggacccgtattgtaaccattcctgaatacctgttctgattaccggcatagatggatgatgactgtattatgccatcgtaccgctttgccacctcttttacccgctctgccgattcggtaacattaatcacctctaccttgatatcagcagtcctgataatcttctgttcagagagtgagacgcctgttttgtccgatgaaatttcgtcatatccaccagctgcccgtgtagcctgaggggcaggggccggagcgtagacataattttcactttcgtatgcagcttttgagcggtagagcgtgtcatcggtgacactcgcctgttgtgtaccctcaaatgcagtgcacccggcggtaaccatagctcctataagcaggagcaacatgagtacagaaagtttcttcatgcattatactatacgaacggagataaaagagcgatggtaacttcagatcaatccgaagttaaaaaacttacctgacaacaacggtggtaacttttgcatgggtcagaatatatgtactgacactcccaagcagaattctggcacccagtccttttccggttgatccgacagcgatcagatctgccccgacttcttccgcggtttgtaatatctcacttctcggatcaccggtccgtacaatgatttcaatatcaacattccggtcatgtgccagctctttgatccggtttatgacctgctccttctcatcatgcaccagtttttcccgaatttcatggagagttgaaatgccctcatacccggcagctccatcgatggccgcatacttggctggagaaataacatacagtgcacaggcccttccttcctcttttatgtgctctaaaacccagataagagcattatatccttcaggagatccgtctactgcaacaagcattgtcccagacataattgcaagagtattgttccggttacgtatcagtataccggattatctgttgaggtccatgtaccagtattgatggcgattttatcttttttcagtgtccattttatatcctgttcgttcttttttttaacgatgagtgaaatatatgtccatttacagatggtataacaccattcagttatcatttccagtaactataatatgacagggacctgagtattcaattgatccttatggatgtcgggtttctctcatctgatctctttacatttggattgatcccggtactcatatttctggcccgtatatgcgatgtctccatcggtaccatccggtatatcatgatttcacggggttttaagtttatagctccggtatttggattttttgaagtaactatctggctgcttgccatcggacaggttatggctaatattaccaatcccatctgttatattgcatatggtgcgggatttgcagccggaacctacatagggatggaactcgaagaacgaatgaaactgggcatggcgatcattcgtctgataactccgctcccgaccgaagattttatcgcccgattacggcagtacggctatggagtgacaaatattactgcacagggagccaatggtgaggttactatcatcttcatggtggtaaaacgggctaaaattcctcatctggcgatcctgattcgtgactttaacccccatgcattttatactattgaagatgtcagatcagcaagtgaaggaatctacccgatagaggacaaaaacaatccattttcaatctttaaacgacccttcttatttattggtaagagaaaataatccaggctatctggccatccacattttctggttcatcagtggcttattctctaatcctgggttctgttcgataagttccataatctcatcgggggtaaaatgatacgggcacggtaatgtaggatcttcacgctcccatcgctgcagtctttccccatacaatgcttcatcatgcaaggtacagaattcttccagggtattgaaaaatatgcattcttcgcatgaacgaatctgtctgacaagaatcggcggtatcatagaactgaatacccttttctgataatcatcgtattaaaattgaatcggttcatatatgggcactgttttttaaattttatgaatgatcaccggacatctattcaaactcagggaagcctttaataatttagaatttgttaggtataatagggggagttcttcatgtccggatccgatgatttctatcaggtactctgtgttgatgatgaggaattcctgcttgaactctgtaaactgtttcttgaacggagcggcagccttaaggtcgatacggctttatctgcttctgatggcctggaaagattaaaagagaaagagtacgatgctatcatctctgattatgagatgccagggatgaatggtgttgaattcctcaaagaggtccggtcttttaatgagaatattccttttattgtttttaccggccggggcagagaagaggtcgttatcgaagcactcaataacggagcagatttttatctccagaaaggaggagatccaaaagctcagtttgctgagttgaaatccaaggtggatcatgcgattaagcagaagcatgcggaaaaaatccttgagcaggaacgccagcaactactctccatttttgacagtcttgatcaggttgtgtatgtcagcgatccaaaaacctatgaaattctgtatgtgaataaaaattttcagaattttctcggtcatgatgttattggcaggatctgttatgaagagttccaaaacaggaaaacaccctgtgaattttgcacaaattcaatcatattctctcaaaaacctcttccttactcctgggaacattataactcagtatttaaccggtattattcaatcgtggaccgggtaatcagatggcctgatggcagggatgtcaggcttgaggtggctaccgatgttactgaggccaaacgcgctctggaagagttaaatgcagcatatgaggagattgcctcatcagaggatgaattaaaacatcagtttcaggaacttaatgagagtagggaacatttaaaagagagtgaagaacggtaccgttcggttatagaaaatacccaggacgttttttaccggagtgatgcccagggaaatcttgtcatggtaagcccgagtgctcttcagatattcgggtatgactctcttgatgaaatcatcggaaaaaatattgccgacatcttttatcagaattccgatgagcggcaaaaactgatggggattttacaaaaaaaaggttcagtatatgattatgaaatccctctggtaaaaaaagataaaacgcccatatggatctcgaccaatactcatatatatcatgacaaaaatggtgcttttgctggagtagaaggaactatacgggatattactgatatcaaaaagacgtcaatttctctccgggagagcgaggagttataccggtttttggtggaacatatagaagacggagtttttatcgtccaagatgacctgattgtcttttgtaatacgacatttgccaatattatcggatattcccgggatgaaatactgggaaccctcatgtatgaatacatctcccctgaggaccgtgatgaactgatatggaaatgtcataattcaaaggaatatgatgtaattcttgaatcatctgaattccggtttttgcataaagataaaaaaaccagaatatctgtaatcatctcattacagattggggaatacaaaggtcgtcatgcctgtatcggtacaattcatcatgctgaccgactttgtgaacaggtggaaaattcccttcgggagagcagggcaatgctcaatgccatcttacaggagtcaccgattccgcaatttgtgattgataaaaatcacaaggtggtctattggaatcaggctctctcagtctacagtggcattccctctaatgaggttattggaacagatgagcattggcgggcattttatcctgagccacggccctgtattgcggatctgatacttgacggcagaattgatgaactcgatgtatggtacaaaggcaatgcaaaacaatcaactcttgtgaaagatgcctggtcatcaatcggatttttttctcatcttggtgagcatgggatctggctatattttaccggagcattacttcgtgattcaaacggtgatatctggggtgcacttgaaacccttgaagatgtaaccgaacagaagatgaacgaagaagggcttcgcgaagcgaacaaaaaactgaaccttctttccgagacaacccgtcatgatattctcaatatgcttaccgttctgaccggggcaattgatcttatcagggatgagatcagcgatcaggctgtttcattctaccttcagccggtcgataaagcattggataccatataccgccagattctcttcaccagggattatcagaacctgggaatcacctccccggtctggcaatccctgtcggctatcattgaagagactattatacgagttcttccaaaggaaattagatttattcagaataacaccaattacgatatctatgccgatgcaatgctcggaagggtgttcgcaaacctggttgataacacactgagacatggcgggacggttactgaagtcagggtttccgccagggaagagcaaaatctgctgtatatcttctatgctgatgatggaaaagggatagaggattcaattaaggaacagatttttaaccgggggtttgggtctcataccggatatggtctctttcttgtcagggagatactctcaatcacccattgtactattcaggaggttggaaccgcaggaaagggagtcgttttcgagatacatgtccctttcaccaattttaggatacatcaatcctgaactctttttttcagtatcaggatgagtcaaaaaagatctcctgaagtgatttcagatcttttatggaaaggagaaccgggatatttactccaattgagtatgagggatagaggccgagcatctgtctccggttatatgcgtacagtctgctctccagaagaagacttcctgctttgatttcttcctcttctctcctctctccgctgtctattcccttaaattttgttaatttgtcaataaattcagagatcattgtcagggctacttttctgctcagataactttgcagatactgcattatgacaaactgcgagaaaagaagaatgagtacactgaaatctcttccggaatacgaaaaggcgatcatattcacgtattttgtcagggtaaatgcaggcatgaccatcgccacgatcatgagtatgacgaggattgttgtaatggtaataaggactgatccaagaatggtaaagacgatgatccttcgatggctgctcatacggtttttcaaacggaggtgagtccggtgcagcattcttcccctgaaaatgaatatctctgcatagaatatgattatcccaagacactgcactaaaagaagaatgagggtatctgttgaaaaattactcgtatacgcgataatgatggtaaagatgacggacagtccgtatatgcaaaaaacgccatacgtgataggaatcatactgagcagaaaaaaccgcaggaagagctgatatcccacccgtttattagaaaaaattctgagttcttttgcccattgtaagaatgatgtatcttttttcttaattaggggctgtcctgataatttctgatgcaccattctgacggggaaaagagcaagtggcaacatcggataaaacagataaaaatacagacttgcggcaacccagagaaagaggtatgtggaccgataatgccatatgagtaggatatttacgagtatgacaccaatgagcactgcaaacgattctctgcagatggtttcatgggttattatttgacgcaggttttcaagccggtttatctcttctgataggttctggtcaagtgaacctggatagagatccccattcttggtgctgtcttttatatcgatcacaacttcttgaataatcaatgtaaaaagaaataaatgaatcgaaacagcccttctctttgtagctgaaagtcaattcacggaccggtgatttttcattccatgactcacagatatatgatatataggctcgatcaggtaatacatgggtgtgcagtatgtcagatatttatgaatacttgtcagccctccatcagggcatttgggaagtggtaatccccaaagagttgctcacagtcccgttgggtcctgaatggaaattctctccgataaatgttccctctcaggataccattgcaagttaccggaatggtcagtatcatcttcatgagacaaaaaccgaataccgggttcaccttgaccggtatgatccggaaaaaaatcctattcttcaccttatcgatgatgctcccctggtcctgatgatcctggagacattagagacaatatatatgaccgccagggatgccaaaaagaatcccggacccgattttataaaagatcaacgattgacatggaagtttcggatggtgctcgggattattctgctctctatcagcggtattcttgtcatgattgcactcaatcaggatgagcggcttttttccatgattctcccctcgattgtctttttcactggtgccctgattcttgcccatggattatatatgggtaagcgaaaagagcattcaaaaaaggatgttgtgaatggatttttaatcatgatcgggggtatttttatggcactgctctgggaattatatctcttcatcattctgttcatcctggccatttggttctttgggagtgcctatgtatcgttgagacgggtaataaaagaaaaaaaggagattccccagggattatggctttctatggggatggggattggttccctggcatttggagttctcacgatctttgtccctgatatacttctggagatcctggtcggcatactggctgtgattgtgggaatcattggttttggatttcttcttgatggctatggccttcgaaatgttgagcacatcatgaaggagcagactgaaaaaccagcaattacataaaaaagtcagagtggtggcctcattgttgccattattctgcatggggtacaggttccataggaaacggccccatacatgggattgtcttccttgtcatatatcctgctgctgatatcttcgcagcagatagttccccaggtattaccagtggccattatatccactgtattcctgttttcaatatcatactgtgaattatcctggaagatatttcctccggtacttcttcctcctccaccaatatcaggccgtgtggcacctccggttgcgatgtaaataccaaccggattttgtttaatggtgttcccctgtatggccggtgttgaatccatcctgacaatgataccataatcaccatttccattgagggtgttaccggtaatcgttgggtttgcagatccctttgtactgattccggcacttccacaggagatcttgttattctctatggaaggatgagaggatgcagtacagtcaataccattcagggttgagaaggtattctttgagatagtggggtaactctcaccatatgcagtaataccccagttcaggtttccggcaaaattgttgtcagaaattctcgggtgagcggttcccagtgtcgttatcccggcatgtgccgttccggaaaatgagcatttctcgatggtgggtgatgtaccatcacaaaggacagctgtcccatcattcgtcccgcccggactattcacaatggaaaagctcaatgaagaaataacagtattatctgccccgataatagatggatacctgcctcccggagagtcggggatatcatatcgtgctcctcctgatattaccggatttggtgataccagaaccatcgatccggaagatgtcactttttttctggtgagtgtcattccgctttttaatctgatgggaaagatttcaccatttgctgcatcatatgtgttggcagattcaaccatgacagtatcaccggatcgtgcccggtttaccgctgcagtaatagttttgaagggtttggtctcggctcccgttccagtactatcatttccggtctttgagtttacatagtatatcatcccggcggggttcttacttataccttccgcgaatagtgtaggtgttttatcctgatttaacggtgctgctgtcagatgccagatgagaagacaccagacaatgaccagaataacccatgaaccaaaggttttcatcatgcataactcctgaaggggagtagactcatgaaaagaaaaaagtttggtatgtgatataaaaaaggatattttattaagaaaaccgataagaaccctgggggaccagtatttcaaatcttgccccctccccatacttccccgtctcccgtattgacagaccggttatcgagagaatctccttgatcagaaaaagcccgaaaccggtattttttccataacctcgttcaaaaatattttccttttcagaatccggaatacctattccgtcatcctcatagagaattatcagatcctgtccctcctgtcttttagacaaaagtatctggctgactttttctccatgcatcagactgttctgaatcagattttcaaagaccatacccagcatctgatctgcaaaaacttcaagaccttttaattcattgactaccttcattccatcagcatttaaagcatcaaccagatgggaaatattctgccattgcgggctttcggctccaatattctgataggtactggtgaacagaatttttcgttcaatatctccggttatagagccaatccggccgattaactctttttcactctcggtgtcaatttcttctgccaggaggtaaagaaatcctttcagggcagtcaaactgtttttcacatcatgacgggtgatgctggtaagcagggagagttttttattaaccatggtaagagcctgggatattcgtctctgttctccgatgtcaaggaaagaaactaccgatccatatcctttcagcctgagtaaggatgccgttgccattatccatgctatctctccgtttgggttttgtataccgatttcaattcctgcaatattttctccttgtttgagaagttctagtaaagggtaggtttgtgatgagctgactatggtgccgtcatttttaaatattgtccattctggtctagagatgcctttatcaatgagttcttcacggctgacatgcagaatccgtgctgcatgctggttcacttcaatgattgcaccattctcatccgtcacgataatgccggttggaacactggagaacagcgtctcatacttctgcattgcttcacagacgatctcttcactggttttacgttcggtaatatcagtaacaatcccctgcaacgcagtaatggtgcctgatttatctgttatcggggaatttctctgggatacccatttcagttctcctgatttggtgataatctgaaattcatacgtctccggaataatcccattgagcaggtctttatatgccttctcaaagtattcaaggctgtgcggggctatacatcttcgaagtaaatctgggtttctataaaattcctcctgggtataccccgtaatctccagaactgagggactaatatattcatatttccattcagggaggcggagcatgaagataagatctcttgatttctctgcaagaagtcggtatttctcttcactatcaagaagagccgattccatccgttttctgtcggtaatatcgatatgagatccgaccatccggcagggattgccttcattatcccatgcaacaacctttcctcttccatggatgtaccggtagtcaccattttttgtcctgatgcgaaactcgatatcaaaccctttgtcctttctggtaaggctctcctgtatctccttttcagcacgaatcacatcatcaggatgaagaagtgaccgccagttctcataattaccctcaaattctccaggctcatatccgatcatccggtagtaccagtcactaaaaaaagcctcgttggtcttgagattccaatcccagattccatcactggtcgcttccatgaccaatctgtaccgttcctcactctcccgtatttgttcagactgcagggcaagttgttcaatcgtccttcgaagctcctcttcagacgcagcaagctcttcatttaatgatgttagttcctcatttttcttttcaagttcaaatgctgcatgtgcgtgctgaacagcccggttcaccatattgattagttcaataaaaagagcagcaggattcccgtctttttgcagatagaatgacgccccggaattcagcgcttcgattgcgacatcctccctcccccttccggtgaatattataaaaggaatgattgcgttcttctcacgaatcttttttaaaaattcaattccgttcattcctggcatttcataatcagaaatgatcacatcaaatatttgctcctgcatggtctccaatgcagctttcgcagatatcgccgtagtaatctgaatcatgccggaatgttcaagaaacatctttccaatttcaagaaaggatggatcatcatcgacatagagcgctgagatcataacgtatcctggatatatgggaattatacccttgagcatttaagactgacctttaatccagatcatatctggatattcagatataggcctgacactaacattttaactgcatgccaggtcagatcgttcttattcatgcagttcccggcaccggtctaagtgagacggtcaatacttatatatcccatatcaaagaggatccctttggctcgtggttgattcttccgacacacagactaatcaggatggttcgggaccagctgatcaagtccggaatcacctttcttcctgaccacatctgcactcctgatgacctgtgcagatatcttatcgaccggtatggagatggaacggttctcataaagccggagacatcacgtcttcttcttgtagatctgttaaaaaaacaccaggatgaactcaccctcttttttgcccagaaaaatccatcgccccgtgcagtccaggaccttcagatcctcatgcaggtcatcatccggagagagatagactatcctgcctgcctggggcctctgcaatctgaaaaaagtcatcagatatctcttctaatatccgcatatcaacacatactcagtgaaaacaatctcgtagatcaggataccctgctctcatggacgatagattttcttaagaaaagagatcctacggatatcaggtcaatcatccgtcatgtccatatattcggactttttgaacctatgccccttgaaaaaagattgatatgcacattgggagaagtaggcgaaaccctgcattatacgcttcccgatgggaaagatccggatattttttcagacacgggtgactggctctcctatgggagtgaggaggtcataccatcaaccgggatggagcagcaaatgacgaccatcttctgtcatgatccatccggaaatgatgactacctgaactttccccatatatctggaatggggttttcagatccggcgacggagatgagagaggtgatacgggaaatcgtgcggttgcatgaaattggagtttcttatgaggatatcgcaattgccactcctgatttcaggtctacccgtgtctatgcgttggaagcatgtactgattctggtatacctgtccgaccatcacaaggctctcttctgcaatcctctccacttatcgcatattatctctccatttttgatctcatagaaaaagggatgcgatatgatgagttggtacgagtcatacaaagtccgtattgcaggttccgatgggagccagaagaagacgcggatcaaaaatcaggcgaccagaagaagagcggaaagagagattcccgatataaatatctttcttataaaaattttgatctcctctgtcggacatatgggttggatgggggtcatatcgactgggaaaaacggctccctgatgttcttttattctctgatgatgagggtgatgaacagccattaccagatgggcaaggctttgttcagagtaaaaaaccagtctcacggacataccacccccggcgcccacttgaaaaacaggagattgcagatacaatagagggtattatcaggctggtaggaattatcaagagacttcgtgacaaacgaactattcgtgagcatatctggcactttaaaacaatattaaaagagatcggctcaccggttcccggcctggcacatgccaattccctgaatgcctggctgacggatgaggaatacctggacctgtcctcttttcacacactgctcagtgagttacaggatctctcagggaccggtgttatctcttacctgaatccggctgtaccggtgacatttattgatttcattggtgccgttcgtcatgttctgcaggaaaagtcaggcaatgtatctcccgatgcttcaggagtcattcttacaggaattcgtgaaatcgctcatcagcactatccttatgtttttttggtctcactcaatgaaggccatattccccggcttacaacacgactcccattcacaaactccagtgagaacagccggatggatacaagaaccctctctgatattctcagacaggaaaaataccagtttattactgcactcgcagccggaacgacccatctctacctgagctggtatgaacacaaggatgaacggaccgtcttgtcatcggtcttcatcgattatctcaaatcatctacgcttctccctgaatggggacgtggttcagatgagggtggttattccgggtttcctggagatatggaggcatcctactctgcaggagtctgtatccataactctgaatgggagagatcacgctcatatattccggaagatgttctgttgtcctcattggtacagaggatatcaattgaacgaacataccggttcagattaaaccgttcagagtatgatggaatcattggagatgatcagattatcaggtcggctctccactttcaattcagtccggcatactcatggtctgcgtcgatgcttgagacctatgcgaaatgtccgttcaggttttatcttgaacgggttcttcatatccggcctcttcctgatattggaagtgacatcccccctgagacaaaggggaatcttattcatgtcattatgagccgtttcaaacggactatgcatgaaaaccgccttctcccgatcaaagaggccgggtttgatactgcactctccctcatcagggatattgcagaggaagagtgtgataaagttccttatacgactccgctctggatagcaaagaaaaggcagattatggggggagaagatatcggtggcggcattctggagcggttcataatgactgaaattgaccgcctgagtcctgatgaagatgggagggttcctcatcagttcaccccccggttttttgaatactcattcggagcagtgagaggtcctgatgatgatcctgattccaggactgaaccggttgatcttctggcaattcagagggagttgaaaaaatctcaaaaccccggtcagaatgatagggatacgagcgagtctgaaaattccattcggtttattggaaagattgatcggattgatctgactcctgacgggctttttggtatcatagactataaaaccgggaagaacattcctggatcatcagaccttacccgtatgactgcattacagcttcccctctatcttctggcatatcagcacatatcttccaataaaccggtttttggctcctatatacaacttcaacgcaaaatccttcattcaatacctctctatgatcccacgttaaaacagacccttcccaaaggaaaattgcccagatcagaaccgcagtggcaggaaattcttgaaaatgcactgcatagttccatctctcatgttcatgatataaggaatggattgttcccgattcaggccacaaccgaatgcaatgcagactggtactgtccgtataaaaccatatgcaggttccagccagacaggggttcacagctgggagaatggtaccggtatccctctgtatctgatgtatgtttagaggaggctgaggcataatggcagcaaccccccgtcaacttgaggcaatctcacggcatgatgtcagcatggtggttactgccggagcaggaaccggtaagacctttgtcctggtagaaaagtatctgaacctggttcaggaccagggatatcgcatcagggatgttcttgctcttaccttcaccgataaggctgcggcagagatgaaggagcgggtcagaaagaccattgcagaacgactcaaagatgatcctgacaatcaggtctggaaggatgcacacgaagagcttgtcattgcaccggttatgacatttcattccttctgtgctcagattctccgggaatttgccattgaagcagggcttgacccgggttttgtgatccttgatgaggggcaggcactggctgtagaacgggaagcatttgaaaccctcattagaaaacctccggaagagatacaggaatcacttatccggcttctcgcacagattgaaaaattccaggtcaatcagatcatgacaacgctcgctaaaaataccgacgcatttttacagtttgcagaggacctggcaggagatccggatggaatcatcaatgcatgggagatttttttagaacaggtcagaaccccggttataaatcagtttttcgctgacacggatattagagatgcaatttcagatttcatcagatttgaagaggtatatagaaacaaggatgatcgtgcagtccggtatttacagcaggtctgtccttatctgtatgatctcactcctgatgccccacctgaaacgttgcataaagcagcggaagaatttctaaaaattcgtccgaccggtaaactggggtcacaaaaaatatgggacaatgatgacttaatccggtttcgtgaagcgaaaacctgccttatcgaaaaccttgaaaaagcagttccatttttctccctgtatatcgataaagattcacgatttactgcatcaaccatcacgttctttagggatctggctctcgtggcaggatattacttcgaccttttacacatgctgaaaaggcaggcaaacggagttgatttcaatgatctcatccagttgacccgggaatttctgcaatcccatcaggatatcgttgcacggcatatcagaccacggtatcagtatattctggttgatgaattccaggacaccgaccctgctcaatttgaaataattactgctattattggtgaattacaaccaggaacgcgaagcctcttcatcgtcggtgatcccaagcagtcgatttacctgttccggaatgcggatgtgacacggtttaaagaagctcagacccgtattctttccgattgcaagggaaatctcatcaatctggatacgagttttcgaagttgccgggaggttatcggatgtgtcaattatctcttctcccgaatctttgcatcaaccgaaaagccctgggagtttggatatgaaccaattcaggtctgcgatgaccgaaaagcatcaccgggttcgattaccgttctgcttcctggaaaggcaccaaaagggagtgaacgatcagaaacaaaggagatagaagcaggaatggtggcagatcttgttcatcagatcgtctcatgcggttcatttcaaattaccgaccgggacggggtaatgcgaccggccggatatggagatatcgcaattcttattgagcgacggactcatcttacccggtatacgaccgctctttccagaaaagagacacctttttatgtccatggggggattggattctactcccggcaggagatctatgatatctataatattctctcgttcctcttacggccctatgatagtgctgcacttttcggtgtccttcggtccccttatttcagcttctctgatccgctgatctatcatatccttaacgttcctggagcgaaacgaagatggagcctgtatgagaagttaagagcctgtgctgaacgattctgtacccgcccctctgaaatagaaccatcagcggagatcctttcctgctcacctgctgaccaggagctcattctccgtgcagcccggttgcttgaatcatggagaaacctggccgggagagagccggtggtgcctttggtaaaccgcattatacgagaatccggcattcttactatctatggtgcattagagcagggtgaacaacaggctgcaaatctgacaaaacttcttggaatcatccgggggagaacagagggaggatactatagtttatttgatctggtacaggacatgatgatctctatcgccgatgaggaacgggaaggggaggctgcacttgataccctctcgaagacatcggtgaatattatgaccgtgcatgccgcgaagggtcttgaattccctgtcgtcatacttcctgacatgggttcatcacgagaaggaaaactgggccccatactttccggtgatcatcctcatctctatggggtcaggattccggatcctgatcaggattttgatatcaaagaaactccggtctatactgcattgtcgcttattcagaaagaaaaggaatcggctgagcgaaaacgactcttctatgtcggagccacgagagccagggatcatcttgttctctgtgggaaacaacctgataaattctatgaatcggttgataagagtaataacaggattgactgggtgtgcacgctctttgggataacaaaggacattgcagaagaagggggcgttattagcattgatccggaagatggcggaaaacctatagatattaccatcctgaccgatcctgatcaactgacccggatgtgggcacaggaagcacttcctcctcttacccttccagatgagtatgccaagttgtccggaaccagaaaacgtggtctttactcggatatgcctgatgaaaaagccacgatcagacctgttccggtgaccgatataggactattgggaaaagcgaccgggcatgaagagactattcatcaggtcacgattcctggtggctctcatctcctgcctgatgagattggaaccctgcttcatcatatcttttcaggaaaggatacaaaatcagtacttgtctcgtatggtatcacaagtcctgaagcagagtccttttgtaataccttatatcagcggttttgcagcactcccctcattcgcgatgcagttcgttcattccaggaagtctcctttataacctattcagggaattttccggttaccggacgtattgaccggctgattcaggacagcagaaatgaatgggctgttattgattataaatctggagacaagaccggtgcagaactgcaactgaatgtataccggatcgcagcagaggtactcaccggccagccggtcagaatgttcctttattctatgaaaaccggagagtttacagagccccgctttctttctgatgaagagatacatgtagctctcaaaagatatctgggaaaataacccctttctccagattgaggttcatcttccgtaaatttttaccagttctgagagccgcctggagagttcttctgatatcatcctctcctgtaaccgccatctccagttcccgtgttcagtacctggtttattcattcttgcagatgaatcaagtcccagaatatcctgtataggtatgattgcagtattggcactgctcatcatcgctagacggatgaatatatcagatatctcatgaatttcgggctcccttccgaggtatgcaataagcctttgtttttcttcatgagttgcatccagttcataccatcccctgaccggtgtattatcatgggtcccggtatacacaaccgaatctttggggatattatgaagaatgtacgggttatccccggttggggaactgaaggcaaagaccaggactttcattcccggaatcataaactctctcataatctctctgacatcagatgtgataatgcccagatcctccgcaataatcgggaggcagggaaattctttcaccagggtcctgatgaaatcccaggcaggagcctctatccaccttccttcgattgcggtatctgatcctgctctgatctcccagaatccaacaagccccctgaaatgatcgatccgtacataatcaaccatggagagttctctcttcagtcgtaaaagccaccaggaaaacccggaattctttatggcatcccagtcatagagtggattattccatacctgcccggttgcactgaaataatccggagggacacctgcaacgaatgttggcctcctttctttatccaaccggaagagatccgaataggtccagacatcactgctatcgtaatcgatatagatgggaatatcaccgataagtcgaataccggcattatggcattttttcctgagtgcctcccattggccggagaagatatactgaatgaacttctcacgttcaattactgaattattcttctcctgaaactcatgaagtgcctggggatccctctctttcaatggatgaggccagtctgaccagacagccggggcataatattttctgattgcggtaaaaagagcgtaatcatcaagccaccatgcctgttcactacaaaagtcgataaaccgggggtctgatccgaaatacgcaaaccggttatacgccatatcaaagagccgttccttatatgcaatgacggctttataatctacttcatcacgaggtccctccaaaccctcctgcagatctgaaggatcaagatagccgtcattgaccatctcctcaggactgatgaggagaggattacctgcaaaagcagagatagaatggtacggggagttatcatacctgatatcggttggatggaccggaaggatctgccagtaccgctgtcctgatgcctgtaaaaaatcaacaaaccgatctgcctgaggccccagatcgccaatcccgaactgaccgggaagtgaagtgatgtgaagaagaatgccactcccgcgggtcttcattctacgtctccatacgtcttcatatacattattccgcgattcatgtcaatctgattatggataattattctgcacccatccctcaatggcatctgacacctaagtactcaccaagcaatgaatattcccgtatccaggtctgcgcatggtcatcgccggtctccatggtctgtttcatcgtatgacacatatgctgacctattcggaaatatgtgttctggcatgcccatagatccattgagagagacattggggagagaaggctgaataacttgtttactaatattatgtcttcaatctggtctggctctttttcaataccactcagaagtcttgcaatggtatgagcagcatggactgagagaagttttgtatcaggaaggaaatttcccctgttcatatcatcaagtatcctctgaattctctcaatatgaataatatcctcatcaagacaggcaataagttccctatttaaggtgtattggataggaaaatcaagtgctataggcgaaggtatattcagttccttcattgcagtaacaaacggaaaatgtctgtggcagagttgatggtatgcatactgagcactttccagggcttcattgagaatactatacattacttttcttttcccatccggaaacaggtgccagagtgagtacgaatgaacatcaaaatgtcgatctagtgacaaaatcatacctggaagatcactttttgtaaatgcattccatatatcctctttaatctcttcaaaatcattttcagatgaataggtccgcactcctccgacgaaattatgatcccccatatgaagagcgataaacatcaacgttgactcttttaatgtactcttcgatctaaagagggcatgccccatggccagctttaaactcccggtctctgcctgttcatatgatttacagcagatctcatagagactcaccggtgattcatcaggtcttccttcaatcagggacatgatagcaaactgaaaagccagtcggttgatatcaaaaatggcagtttttacatatttcgtgtagatatccccgccatttccaagatgtgccagattggaaaaacctttttcaagatacctgataaattcaggttcaaagttcataccggtcacatcacgtgccagctgcatcgcccggcaggcatacatcataatctggacggtttcaatgccggcaagatcatcaaaaaaccacccgcaactggtctgcataaagagggcattcttctgcatctcaagaagtttgaggcatcgtgttatctcttcaggattgggtgtccgtttcgcatatgatgtaaagaaacgtgatatctcttcataagtgcggtgaatgatgatgtcaccgtaggcatccctgatctgccagggatcatgaaagaatacttccatctcccgttcaaaaaggaccgccagttcattgatgagccatgatatcgcatccctgagaggcctccgccatttctggttccatggtttaagattatacggggatgacccggatgtgaatgatgctggataacagaccgatgtatccgaaatcaggcaggcgtataacgcccggcaaccacaatcatcctcccagcgtttcacaccatgactacagctccatgaggtgttttctgctatggccacttcatatacgggcggaaatctctccaggtattcgccgtatatagtaatctttgccagattctttgattcaatctcatggagggcatatgccaatgccatatcagcaaaccggtgatgatgtccatatgtctctccgtcggttgcaatggagaccagatgtggcctatgagaatcgcgtgggaatgcctcaattagtcgtctcgtgaactggtcgccattttcgagcaggtttccaaaagccacctcccctgctattcccggctcgtaaaaaaatatggcaatggttcttcctgagggaaggatgcacagatatggtctgccgatatccagtgtttctttggtaacatcgctccaggtctcttctcctatctttcgaatccgcctggcctggtgaggtgcaaggatggtaaaccgtatcccatggagggcaagaagatcgagggtttcattatcgacagcagtctcagataaccacatcccttccggcatcctgccaaaccggtagataaaatctttcaccccccagagtatctcggtttttttatcccggctgtttgccagaggcataataaggtggttatatatctgggcgattgcggatccatgacccgaaaagatctgctgactatctttatccgcctgaaggatggcctgatagacctcctggttatggttttttagccatgagagaagggtcggcccgaagttgaaactgattctggagtaattatttacaatatcgatgatccggcgttcagatccgagtattcgtgacgctgcgtttggggcataacattcattggtgacccgttcattccagtcgtgaaaaggaaatgcagattcttcaatctcaatctcttccagccatggattttcccgtggaggctggtaaaaatgtccatgaatgcaaatataccgattgatagagttcacccagcctggatcctgaatcatgtatgtatctcttatgaaacttttcatggtttgatagttttgttcctctccccgaatgggggacctgtccgtgagattatccgggtagtgacaggtatatcaaaattttgagatctctatcctgttttatccggaaactgccaaaaaacatatatatctatgccagtactgtttttattggatttatgaacccagataaccgcaatagtcaggttcagacaataatggctacgatctcctctttgatggcaagcaggcggattgaagataaacttcgtgcagcatccttacttggacaatataagaatgtccttccatcccattttctggatcgcatcctggaagaactgaaaaaagatacgcataccgagattcaggaggcattacggccattattaacgtctgaagaggaagagacaaaccctgttcctgtatctaataaagagattattgccgggtactccggttcacttgaaagtgccctgaaaaaagcgcttgatatcgcaaatatctttgatctttctcatgtaactgccaaagcattacggcagcagctcctggaaggacgaaatggatcagaacatgatctctattcagattttgtccagcaaaaatccagaatgacacctgaacttgcacttttcccgcagatatccttgaaggtctctcccatcggagcattgtctgaagtgatccggattatccccgaattatccaaaaaaggggagaaaggaaagatacagtcagaacgaaagaatatcgagacaaaacttgacgaaattcttgaaactgatcaggagatatcatttaatattgccggatatgaactcctctatacccttgagcgaatgatgagggacctcatccatcagcgaattgtaaagcccaatatggataatctccagacaaagatccctgccgatgttctggagggtatgaaaaagcgaaaagaggttgaagagaataatccaatatccatcggttcatatgagctgattgagtactgtgattttactgaccttaaaaagattcttgaaaagggtcgaaatcatgaatctttctctgatattttctcatttgaagagataaaaacggtctatagcaaacttggtgaacttgatcccattcgtaaaaaaattgcccattcccgtcctctgacaagaaaagagtttgaacggctcaggctttatgcgacagatattctagaccgaatcagaaaataagagagctgattctctgactttttttcattatctatatctcaccgttcgctgatcttaaattcagattcctgaattgatcccaattgagtataaacactaatatcaacattcatcagatttaaaatctctcgatgcttttgatttatcccagtaattgtgtaaaaaacctgttcaccataaaatgaaactaacaaataaatctctttgaaaaactcaataattctttcagttttaggattatttactattttcgttggattatattcgaaaagaccactcaaaccctgacctctacttttcagcgaatccctgacttttttctcaataataacaagtggtctcattacaatagtcaaaaacttcactaaaccatcaattctgtcatctcgttgaataaacattggggcaagtgaaagtgcctttcccttcagccgatgaaattgatgctctatgatatactgatcacggtaagtcagaacaacatcttgcatcgataattcattttctggtttatttgttacatataccctccatcctgataattcctgcgcttgttgaagggcttgcaagttaatagttggtttaacctcaattctcgtcgattgttcaattctggcgggattgtttccgtattttcgttttggagtattactaatatgctcgatatactcaacttcgaataccgctgttaatcccttatctccaagaatagcatgtactttttcttttgcttcctcgattgttcggtaaattttctttccctttcctcttttattcattgaatttatctcaaagaaagctttttttacttgctcttcaagtgataatctgaatttatttgcatgagcaaatgattttgcgtagattagccgttcctcccaggttatgattttcccctcatattccattgaatgagatatttttttctcaaatccttcggctataatcgcatcgcttccatcatagtacgatcgtgaaacttgtgtgaaggaaagattagactcctgatgtgctatgattgcagaataaatttcctgagtaggatgagagacttctgataacgggcataaataaaagtcattattgatagtcgtatacaaacgagttgctatggcacccattttgcaatctcccacaaaaagtaatccagattgtcccgtagattttttcaccttttccattgcagggatatagagaggatcatcagcacaatttccagggactacactaacggtgaggggcaaacccagcacatcaagcactgaaagtacgatttttatttgagggagggaggcgtcatcttttgagttgccaaattgtattaatccgtttttatcgataattccattgctgtttactgttgtcatatcaagacggacgatgttttcatccgttaaaccatatatacgcagtgtagaacgatttaattcagattcaaatcggttccaaagttcattattgtgcaatagagataatatacgagccaaatggtcatcagtaaagcattttggactaaattgaaaaccaatcaatttttccagtaaattttttttggtagtaacccacttctccaagggacacatacgatgatcattttcggtcaggcagtagcagatccaaatggcaatcgtttcaccaatcggcaaacccacccagtttctgtgaggcgaatatacctcattcaaaattcgtatgatttgaagttcttttaatgtttcaaagatatatgggattccgccgatgtgttcaatttgatgtgtcggagcgatcatcccatatatatgtacacttctcagatataaagttaagctttataatttaacatttaccttataagatcagcgaaaggtaagtatatatatcggatcagtagattcctgctatgaatggaaaaattcccgggtcatcacgaatagggattcttacatctggtggcgatgctcctggtatgaatgcagcaatcagggctgtataccgtgccgcacatgaactgggtattgaagtagtcggaatcaggagaggattttccgggctgattgaaggggattttttcctaatggacagatcgcatgtggcaaatattatccacctgggtggcactgtccttggaacttcgagatctgaagagtttaagacgagtgaaggacggaaaaaatctgcagaaaatcttaggaatgctgaaatagatgccctccttgtcataggcggtgaaggttcattcagaggtgccgacctcttcaatgatgagactggtatcccgactatcggcattccgggctctatcgataatgatattccagggactgacttttctatcgggtttgataccgccataaatactgcccttgaagcgattgataagatacgggatacggcaatatctcatgggcggttattttttgttgaagtgatgggaaggtcttcagatctcatcgccatcgagagcggcattgccggtggagctgagtacctggttctcccaggggatcatgatgccattatggatctctgtgccaggctgactgatgcgttttcagcaggaaagcgatacgccatcgtagttgttgcggaaggtgagagaccgggttgcagttttgagatatcaaaaaaggtatcagagcagatagatattgagtcgcgggtggtggttctgggtcatattcagcggggaggaagtccgaccgcacgggatcgggtcctggctgctaaactcggggtaagtgctgtctacgcatatacaaaaagtcatgccggggtgatggttggtgaactgagacggagcgtggttcttaccccctttgataaggtaatcaccggacgacagaaaccagaaccgaatattatccgcctggcccacattctgacaaaataatctccttgttcagtttggccctgattgccatccggtatccgcagatgacctggatggtatcaccacatgcctcattcatcgcctggtttccggtatcgatatagaggctttttgtgtttttcagttttgcttctgttgcaaccacaataagggcatcgataccagttcttgccagaacatgatgacttatctgctggtttccccgcccgagaataaacccctgtgctccaatggggctgataattatcttcactttgccataatgatcgagaaggctgagaatctgtctctcattcagatcactcccgacaactctgccccgatatactgcatcaaccccgaggagggtatgactgatcccaagacgctctgcaattgcacctgttgtgctccctgctccaagaagatagagggtatcatcacgcataatctctgtaatgaacgacgctatctcttctgttgcccgccggtcatcaccacaggagatctgcttgcatgactggcaggggatagatgatgaaggaatttttgcataaccaaaaagcctggtattcagatttcctttccggtaatcttcctcatccacatccatgacttctccgtcggtatacgaatatccgttccattgagagagaagttttgctgcagactccggcgatgtggcaaaaactccggaatagatcttgacaccggtcggaatacccaggataagggtttttgctccggtacaggagtacacgtcccgtgctgtcccgtcccctccacagaatatgatgatatcgcagttattttgaagaaatttcttacatgcctcaatggtatccgcagcggtggtggatatggatgtattctggtcagattgagaattatctggatgatactggcaggtataggaaatttttgcagatttcagttcatcttcccccatctccccgcctgccgtgaaaaaaaggagatctttccgggttaggccggataaaaacctgattgcttttgcaggagattctctgactgcacccctcgctattgcttcctttattcgcccgtcagttcctttcaggcctaccgcaccacccatcccggcatagggattgacgataaacccgacttttatcatgagatggcagggagttttttcagggattctgcaatcaattctgccggatattcataatcaacgagggatcctgcaaagtatccttcataactggagagatcaaagtgcccatgtccactgttattaaagatgatagtctttgcctctccggtctttttgcattcaagtgccttgtcgattgcaaccctgatggcatgtgcagactctggtgcaggaatgataccttctgcacgtgcgaacatcaccgctgcatcaaacacctcattctgatagacggaggttgaatcaatcaactgatctgcatgaagtcgtgataccagtggtgccattccatgatatctgagcccaccggcgtggatggagggagggatgaaatcatgaccaagggtgaacatcttcaggagcggcgtcagtcccgccacatctccaaagtcataagcatacatccctctggtcatggatgggcatgcagctggttctaccccgatgatctccacatccggattcttcccgtcaatcttatccttcacaaatgggaaacaaagaccggcaagatttgaccctccacctgcggaagcaatgacgatatctgctgtctcatcaaccatatcaagttgtttttgtgcctcctggccaatgatggtctgatgcaggcagacatgattgaggacactaccaagtgagtaatttgtgttgtcatgggttgctgcatcctcaaccgcttcagatatggcgattccaagactaccgggggtgtccggatcttttgctaggatcgcccgtccggagttggtatctggtgatggcgagggaacacaggtggctccccaggtctgcatcatcatcttccggtatggtttctggtcataacttcccctgaccatgtagactttacattccataccaaagagctgggtggcaaatgcaagggatgaaccccattgacctgcaccggtctcggtggcaatccgttcaatcccttctttcatattataatatgcctgggctatggcggtgtttggcttatgtgaaccgggcggacttactccttcgtacttatagtagatctttgccggagttttcagtatcttttcaagacggtgtgcacggaagagcggggatggtctccagagggtatagatatcccgaacttcttcaggaatgtcaatgtaccggtcctggcacatctcctgtctgataagttcttttggaaagattggttcgagatccacaggtccgaccggcttttttgtctggggatgcataggaggatcgagaggggtttttaagtctgcctgaatgttataccacttttttgggatctcattctcatcgagaagtatctttgtgttcatgtatactttagtttatcaatgactatatttatacattcgtgtacgaatttggaaattgtgattcagtcacaaaaatttcggcgattatgaaatatggaattaggtccttgttttcaggtatacagcgaagattattatcagaatggcaggccagatcatggcccatccggtaaagcagaatattatcccggtcagaaccagagaaacggcactgactcccataccagaccaactgtctttcatgagcacaagacctgctgcacatccagcaaaataggtgaggataaacgtcgcatttggtatctgaatgagcacatcaagagttattatcccactaatataaataccgagtatcagataaaaacaacagaaaaggaacgccagcccgccgacaggggtctggtaaaccgaatgaaggagtgagaactgccgtggtgcataccctgcctttgaaatggcataggcaagccgtcctgcagcaccggtatatgcaatcgccggagcagtcgtaataaacagagtaataatgcctgcaataattactccggaagtcccgaaggatagatgtatcagatgaatgagggagacttcagatattcccggtccataactcttcgtccctatgacggcacatgcagttgccaggtacagaatactgatgatcaccgaggcgatgatggtgcccctgaccacatccctgcccgggtcttcaaactcttcggtgacatgtgagatagcctcccacccaagaaaacaccagaaaatgagcgttgcagcatgacccacactcggccatccgtgtggcataaatggaacaaaattggaaggttcgatggcatggatacttcctactaccgctccgataaggatggcaatggtcgcagcaacaacggccatctgaaccccaccggtcagtcgcatcccgaaaaaattcgttcccacagcaatgaagatgataattccggtgataattagtctgcctgtttcgcccagaccaaacgctgttgctgcatatcctgcaccggtaagtgcaattatggggactgccatgatggctgatagtagaaagaaccagccgacaagcatgccgatatctgcattccatgctctggtcacaaaatacgagacccctccggcgtgggggaacctgaccgagagaaatcccatactcagcgccattggtatcgaaagaatgctcatcaggatccaggcaagaatagatgcaggacctgctgaatcggcagtaaggccaggtaagagtaaaatccctgaacccaggactgatccgatatagaggggaataatctgccagagtgacagggatgcggtttttggtattgatggctgcacggatatcacgaatattagaaatggctttatgaacctctatccttagtattcagacaagaaaaatacatccctgaacatactggtaatcaattataccttttcttcttcacggatgctttccaaccatgcattgaaacgacgaacaaatgtaattctcacctcctggttatcatgagatatctgagtcagatttggttcatgagtaattttgcataccgctggtatggtatcagacactccatcccaggtatttactgggaaacctgcccgttttaacaatggatcccatgttgcatctatcagtttccattcacctgtaagaaaaacctctaaacagagatggactgatgatggaagttctggaaaaagaatggttattgattccggataatcaattggctgatcctgccacctgaacgggatgtacctatatcgggtcatgaatccgagttgttctaacatccatgaaagaagttggtgtttcggtccgcaccatcctttattttcagtaatcatccgccgaatgatatcttctgattcattccaatcggggacgattgcatatgggatatccctgatatgagtaaagacagaaataaggctttccttttttaaaaggcctttcgtccactcttgtaataaggaagagtaaaaagtatttccgctcattatgtatggttttttatatctcacgatcataaggatttaaccccagttcaggatacatataagaggaaagttgtatctttcttcagctctcatctttcctaggacttttcatccatagaatgtatggaggattcacaccggtgtcagaagataatctgaaagcagtttgtatttatgcccggaatcagaagggggtcctgaaagagatagccgggacctttgcagaccataatgcaaatattgtcatgatccatctggagacgatacatggcaggactgaagatgtttttgatgaactctacattgaatatgaaggtgaagttcatcaggatgatctcctcagtgccttacaggaactgtccggtgtacgggatgtcattcagcatgtttcttttggggatatttatggaaaacgggttatcatcatcgggggaggggcccaggtagcccaggttgccatgggagccgtcaatgaagcagaccggcataatatcagaggagagcggatatctgtggataccatcccacttgtcggagaaaaaacgcttgcccaggcgattgatgccgtgacccggctgccccgggtggagatcctggttcttgccggctcaatcatgggaggagcagtttcagaatcggtggatcgggtgaaacttgcaggcattcctgttattgccctgaatatggctggaagcgttgctgaccatgccgaccttgtcgtcaccgatcccattcaggcaggagtgtttgccgtgatgcatgtatctaccatagcagtatttgatgtaaaccgtgtaagggggaaaaaattctgaatatatcattagaacgggcattagatgtcctgatgcatgatggtctggttgtatatccgacagataccctgtatggtcttggagctgatgccttatcggatgaggcaattctgaaagtatttgaagcaaagggccgtgaatatcataaacccatctcgattgcggtatcagatcctgacatgattggtgcggttgcctatgtggatgagatggcagagcagtttattgaagagttccttcccggaccggtcaccctcatccttcctgcacgaaatattttatcaacacggcttaccgccgggacgaaaaagataggaatcaggtatccgaaccatgaggtggcccttgaactgatatcccggtatgacactccgataacagcaaccagtgccaatctgtccggtggtcctgaccctgtcacgattgatctctgtaatgtaccgtatgactgtgcggtaaatgtcggaccactctctgggacgccctcaacggtcgttgatctggagtttcgtgagatcatccgggttggagcagatatagagtcagtcgcatcatttctggcaaagtggtcctgatgaaaccgattcgacttcgtgattttgtcagggatacgaatggatggtactatgccgttgcaacctatgacaacacctttaccattggatcggtcctgcgatatatccctgacccggccggagaccggactgatggaaccggaaccaggtaccggaaggtagagtttgaagaagcgtatcgtctcatcgcagagcatcatcctgactgggcaggtcttgttcaccggattccgcatgatcagataactgccgtattaaaaccggatgaagcgatagaacagatcgcatctactcatccgaaggttgcacaactgataaaagccctccatcttcctccttgtacctttggtgtgacgggttctcttctttgtggtcttgggggagaaaattctgacattgatggggtcgtgtatggtccagccttcagacatgcccaaaagcagctggtcagggccattcagatgggttcggttgaggagctgagtgaagatctctggaagaccgtttacaggaaacgcaatccagatacctcatatgaagaattcatcctgcatgagaagagaaaattaaaccgtggtcaggtggacgggacatatttcgaccttctttatacccgtggatatcaggatcttccaggttttaccatggagaaagggaccattcttggaaaacgggtcattgaagctatggtaattgatgatcagtttgcatttgacagcccggcagtgtatgaaattgatcaccctgaaatctcccgggttctttcgttcacgcatacatacaccggccaggcttttaccggagaacggctccaggcacaaggaattgttgaaaagcacggaaatgagcaatggctggtggtcgggacaaccagggaagcgaagggagagtatatcagatccctgtcacttcttgagcaggaaggatagccgtcgtggtgcattctgtgcacaccggtccgaaaacctgcatcgtgagcatggaggattcagaggtttgtggggaaactcgccattatcgatctcttttacctgttgaatcagatggagtacccttctccggtctttcggtgtcggttcataatatctgataatacctgaccggacatattcaatatatatgcctggtgttttcacagcaccggcctcttcaatgcagagcagaaaggctgcagttctgattgcatcctcagcccagcacccggttttcggagccatagtgcaccgggtcagggtatattcaccattttgtgcatgatatttatcaaggagcccatgaattcctgctctctctgatcggacagaaatatcagtctctgtccagggtctgaccggagcatgttccattgccatgagacaatctctgaggaaatgccttttatcttctgatatctctggatgtatcatatgaagagtataccagagttcctcttcggtcgaacccttctctgcgcatgagaccagtttacaaatactgtactgtatcgcaggttttgaggggatatctttgtaaaagaaatactgccgtggacaatgaaatgctctgataagagatgatattgcaataccattatccggatttttggaatagcacggttcggtcattttattggaacaggcgtcaaacaagtgtgagatggcatcaaatgaaattcaggtaactataccaccaaatgtagagccggtctacagtaatatgatccagatagcttataaggaagatgaatttacgttcatttttctgcatcagataccggggatcaaccaggcacggggaaaggccgttgtcagtatcagtccaaaccatgcaaaaaacctcctcgccgttctgcagcggaccgtcggtgaatatgaacaaaaattcaggacccttgaggctccccaggataaacagcagaacgttactgcaatgaccggatattcataaaaatattctcttaaaaaaatttagtaaacccttcctagggtctcgtttctctatttttaataaattggtgaaaaatgcagtcccagaaaggttttgggagattagtatactccctgtgctttcacccggtagatctggtacagcagtcttccgacaacccggtacatcatatccagttcttcaaaacttgggatactgtgtgaatgaaggatatgccggccacgatccatcgatgctcccccgagcagtgttggaataattctcttatcagtggactttgagaatttgagtatctgatttgccagctgttcggatgagaggatgttgtttgggaacccgacgataaagcacatatcccagagtgcatcgttctttgcaagcacttcaaaggtcttttcaaaccgtgcctcggttgcgtcaccgagcagatcaattgggtttccacggttccagaactcaggaaggaacgagtccatctctttgaccaggtaatcaggcaggtcaatcatcttgataccgtaccgctcggtatagtcagatgagagcaccgcaaatcctcctgcgttggtaacaacgatggcacggcgacctttgggataacgcttcggatgagagagcatctctgctgcaaggaatgcaccggtcagggtgtgtacaagcaggacacctgattttctgaatgcctcaacatagacatcataggatccggacagggacccggtatgtgatgcagctgctgcctgaccacgggcagatgacccggcctttaacgcaacaaccggtttatgcctggatacctcgctcacgatctccataaaggcttttccgttcttgatctgctcaatgtacatgatgataacttttgtctccgggtctgcggcggcggccctgagataatcaaagaagttcagatcagcctggttcccgacagataccacaaaggagaacccgatatccttggtaagagaccagtcaacaacggtgttgacgatagcaccactctgtgagatgaaagcaatgttccccggatttggtgactgtgcaacataggttgtgtcaagcccgatcggtgggatgataagtccgagacagtttggtccgacgatcctggtcccgtatcggtgcgcaatctcaacgatacgttcctcaagcatccggccctcctcgctcatctccttaaatccggcggtaatgacaaccgcaatcttgactcccttctttccacactcctccatgaccccggggacgtgtcgggcagggaccgtgataacagcaaggtctatctcatcatcaggaatatcaagaacggtggggtaggctttcagaccttgaatggtgtcacgcttgttgttaatcgggtagactttcccagggaagtggagcaggttatgcatgaccgcatatcccatcttgttcttgtcatcagaagcacctatgaccgcgacagactttggcttgaaatattccggtgggattggttcaagttcgacaacatcaagaagatggatgtcattgtccatgatgatacgggcatcaactgcacaggcacctgaatcatataacctgatcgggttgatatcaaactcacgcaggtccttttgatcctcaaacatcttgcagacgttcttgatgatctgaataaggcactcctcatccttgggtttggaaccgcggtatccggtgatgagcgggtaggagtcaatatctgtgaccatcttcctgatctcatcctcgtcaatcggaaggatacgaagggtaacatccttcatcagttcaacaagagtaccaccgataccaaaggtgatcacctttccaaaagttgggtcagtctttcctccgatgataagttcaagaccgggagctgcctggttctcgacaattactccatgaatgtcagcattctggttataggcacgggcatttgctacaatctggttaaatgcagactgggctgattcttttgttccaataccaacaatcacacccccggcatcactcttatgaacgatatccggtgagatgatcttcatcactaccggaaaaccaatcgcttctgctgctgatcctgcgtcttccgcccgtgtaacaatccggtacttcggggttggaatcccatattttgaaagcagatcatatccttcagattcactgagcatccattctgtcatgtataacctctgctatgtcatgccggatcttccgacttcaacaaatgacgtatgatgattcgtcaaattctgcacttacgatgtgagccaccaacccatataaaacaaccgtatctgtcgatcaatgacaattcaagaaaataataaagaatttaaggaattgtccatgataaataatgataattggggtgaataattatctcagccgaagagttgcacaagcctgaacaaaaagtatactatcctgacccgtgttaccgggattcagcgctcattcacgattataatgagttatattatgaatttgaaaaagacccggacgcattctggcgcaggattgcatcagatctcctctggttcaaacaatggaataacgtcaaggtatggaaccatccctacgcgagttggtttaccggcgctgaattaaatatcacctataactgcctggagcggcatgtcaataatgaccggagaaacaaggtcgccatattctgggcaggtgaaaatggccgggaacggatattcacctattatcagctctataaagatgtcatgcggatgggcaatgccctcaagtcccttggggttcagaaaggggatcgggtctgtatctatcttcctggtattcctgaactagtagtttctatgcttgcctgcgcccgtattggagcagtccataccgtagtctttgccgggtatggagcaaaagccttaaatgagcgtatcaccggtgcaggagcaaaaatcgtcattactgcagacgcgtcagtgaggcgtggaggcagcatacccttaaagccaatcgtcgaagaggctctgatcaatgctccgactgttgagcgggtcatcatcctgagaacccaggaaccaaaggtaggccttcttgatgagtttgaactggattatgaagaactcattgcgcaggcagatcggtattgtgagccagtccatgtaaactctgaagaccctctctttattctctatacatcaggaactaccggagccccgaaaggtattgtgcatgcagccggcggatacatggtcggtgcctactacacaacaaaatatgttctgacacttcgcgagaatgacgtgtactggtgcacggcagatcccggctggatcaccggacatacctatggtatctatggcccgctcctggtcggcgggacgattttcctctctgagtacactcctgattaccctgatgccgggatctggtggaaacttatcgaggattacggcgttaccatcttttacacagcaccgacggcgatccggatgttcatgcggatgggagaagaatggccggataaatatgacctctcttccctccggcttttgggctcagttggtgaaccgctcaatcctgaagcatttgaatggttttacaaacatatcggaaagaacaagtgccccattcttgacacttggtggcagaccgagaccggtatgcatatggtaacaaccatggtcggcctcccgatgaaaccaggatttgcaggaaagccaatacctggtgtaattgctaccgtcgtcaatgaagaaggagatcctattccaccaggaactaccggatatcttgctatcaaggaaccctggccttccatgatgaaggcagtataccaaaatgatgagcgataccgccagtactggagctttggaaaatacggatattacagcagtaatgatctggcggtcatggacgaagatggctacatcatgctccttggcagatcagatgacatcatcattgtcgcaggtcacaatgtcggaactgccgagattgaaagtgcgctggtttcacatagtgctgttgcagaagcggctgcaattgggaaaccggatccactgaaaggaaatattatcaaggcgtttgttatcctgcgcaacggagtggaaccatcccagaaacttatccacgacctgaaataccatgtccgtatcatgcttggaccaatatcagttcctgcagagcttgattttgttgatagtctgcccaaaacccgcagtggaaagatcatgcggcgggtattaaaagcaaaagaaatgggtatggatcctggtgatatatctaccctggatgaataatcatccaactctttatatactgttttaatagatttataaccatgtctgcaactccagatacttcgctccggatagaaaatatcgtggcttcagcgaagatatcagaatccctggacctcccccagattgcatctagcataaaggatgcggaatataacaaaaagcggttcccgggtgttgttatccggatgcagaacccaaagatagcggcattggtatttggatccggaaaagtggtactgaccggagcaaaaagtgttgagagtctgaataagggacttgagatactgggcgatctgctgcgttccctgaacatcgagatagcaagcgaactgacatataaaatccagaacattgtcacgtccgctgaccttggatccggtattaacctaaacaagattgccgtcggattcaaccttgagcggattgagtatgaacctgaacagttcccgggtctggtataccggcttgaggatccaaaagtagtagtcctgctctttggatcaggaaaactcatcatcaccggcggcaaggaacctgaggatgcgaagaaggctgtgctgaagatcgttgatgatttgaaagggctcgggcttttataatctggagatcattcatctgaatttataattcagattctatatttttatatacaatagaatttattgtacatagtaccgttttccgggggattattgtagcgtcacaatatggatacggtatctgattgacagagaatgtacggagaactctccaaaatacagaggttcccgggtttatttttctattctctgcttttccggacagattaatcttgccataaaatgtgaataaatctcccaaagaatggaagtttttgattatggtaatccgattatacggggaccgctctcttccccgatgatgaccgtcgtctttgaagtgaattcagcaaaaatgccacaacttactacaccaggaatcatattgatggcagtctcgagagccgacgggtccgggatgctgaccggcgtataatcaaggatgatattaccgttatcagatataactggcccgtccttttttaccccttccctgacagtcaccattccacccatttcattgagccggcgaatgacatggctgaatgaaaacgggattatttcaatcggtattggtccggtcagatgcgagcatatctttgacgggtcagcgacgatgatgagccgggttgaggcatcggctactatccgttctctgacatgagcagctccccggcccttgataagcctcatttcaggatctatctgatctgccccgtcaaccgtgatatcaatcttctctgcctgttcaagaccgatgagtgggattccgagagctcctgcccgcatggttgtctggatagatgtggggatcccgacaatcaacagaccctcttcagtcattcgctcttttagtcgtgccatcgtaaaggcaacggttgatccggtcccaagaccgaccgtcatgccattagtaatataatcagcagccttgtagcctgcccgtttttttgcctgttcctggggggataatccgctcgtattcatggttctcctgaattttgtgttggaaaatagttagcgatatcgttctattctaatgaaaacagtcttcttaagtcatcggtccctgcataagcggtgcagtcaagggtgataggggtgatagagatgttccctttgtggatggcatgcacatcagtcccttccggagcatcggtaaccaatggaccgttgatccagtaatagggttttcccctgggatcaagcctcttttccaccccggtaataaacaaatgttcggcaagatgggtaatctcatatccgccggttatgatggaggggatatttacattcatgacatgagtaaaggaaggaaatcctttctcaagaatccttctgatgacgtcacgcaccacccctttggactctgaaaaccgatctgcgaggtgtcgtgcatcatcaaatttctctttctgatcttcaatctggagggagaatgccacggcaggatatccatgatttgccgcctccagggcagcacccacggtaccggatgtggtaatggcctcatatgacaagttttcaccaatatttatccctgatacaacaagatctggctttactcccaatgcaaaaagcgcaagtatgaccgaatcggttggttttcccccgactgcataggcggtaatatcaccccggctcaccgtgttcactctgagtggttcaaatatggagagtgaccgtccgacagcactctgctgggttgcaggagcacacaccacaacatcagcccattcaaacagggcatcataggcagcccataatccctccgaattaaccccatcatcattggtcaggagaatacagggtcgttttagggaaaaatggtgatgtgatggtgtactgtcaggaggagatcctgaaatcatgtatcccgattattagttctcctgcttcttaatggatcatcaaaactgccggttttcagatatcaccagcagacccgggtaccccgaatcggattattttttttctgatcctgccaacaagtagcgatgaatattctgcttgctgaatataccgtcagtcatgatccgacgttagcccctgaaggtcgcgccatgcttgatgtactgacacgcagtttcacaaagattggatatacggttcacagtcctgaaccgggcagggatttttctgaagagatagcccgtcttggtgcacaatgcgatgaggggctggtcatcgctcctgatcacctgctggccaggtttaccaaaaatcttgaggatgttaccagaaatatcggatgcaactcattttcgattgcagtctgcgcgaataaaaaaagaaccggacagattttacaatcacatggcattgatgttccaaaagaggtcacatcaggaaaacgcatcgtcaaagaggtatccggatgtggagcggtcggtgtaaggctgaccgatgggccggcaggggaaggagagtttggccaggagtatatcgagggtgaacactattccatgagccttgttggtggccgggtcgtcggtgaggtgtgcctttattatactggaaaaggtcccctgctccttgcattaaaccgtcaggatatcaggtttaacaaagatgggacggtcgcctaccatggaggagaaacaccagtcgatcatccaaagaaagaggagatgtatgctcttgcgtcaaaggcggttgaagtgctgggttgtcaggggtatgtcgggatagatatggttgtcaaccctgaccggattgtcattgttgatgtaaatccacggccgactacgagcattattggtattgacgcatgcatggaggaagagattgcacaggtgatcctggatgcatcatatggacgttctcctgaatcagttcacctaattggccatgcatacttctcttcagagggtcaggttacctatgatcggagttgacatcggaggggcaaatctgaaggtagtcgatgaagccggggcccatattcactattgcccactctggaaagagacgccaataagagagatattacaggactattcatcggcagataatgctgcggttgtgatgagtggtgaactggccgattgttttgcatcaaagcaggatggtattgaatttatcttcactgctgtccgggatgtctttcctcatgccatcttctatggaaccgatggacaatttcatacaacgcctgtcagtgatcttgccgcggcaaactggctggtgatggctgatgttctccgtgaccggtatcctgatgctgtcttggttgatatggggagtacaaccacggatattatccccctgaatgcctgggaaaccctgaaaggtcagaccgattttacccgcctgaaaacggggatgcttttatactatggtcttcttagaactcctgtttcatctcttatcaggtcagtctgtcttgacggatctccagttcgggtgagcactgaatattttgcctgtgccggagatgcccatgtactgatgggacttataccgccggagatgtatacaacagtacctcctgattcctgcagtccgtcatgggatcattgtatgcgccggatggcacggatggtttgtgcagatgtagcggagattggaacggaatatgttctgcatatagcgcaggcatatgtgcatgaggaacaggtatgtattacacaggcggttagatctgtgatggagcagtatgcatgcagacgcattctgacagtgggtgtgggatcaggtctcctgtcatcatggcttgatgcgcatgatctcaatcgcgacatggggtcactttctgatgcaatgccggcatgggcggttcgggaggcaggtttacgaaccgtctgatcctctccttccttctcctggcaggatctctgggaggaagtctcctcctctggtctctggggtatccgttcttctttctgtttctctttattcctctgataccacttctgggaagggatcacgagattcactattgtccggtctgtggatgggagacggctgggaatgaacggtattgtccctatgatgggaacaggcttgaatggaaaacagaccggtcacaccgataatggttgctgtccataccggtggatctctttttgagggtgcgatgacccgggtgatatggggcagtcattcagggttttttgtgctgtgatatttctccgcgctatcgtcttccggtttttttcagtaataatgatataccggtcggactgaattcccagttgctcaataatatggtcataagtgactgaaaggagaacgaccggggctgtgtggcgtgcatgggttctgcattcttctgcgagaatcggaatactgttttcatattcctcaaaatgctcacgtgaatacagaataaaaagaaggtgtgattcatcttttctaatcgccccgataagtccgctcatcccctccattcttctgaagtcgatccggtatttctgatcaggaggaagacagagcagcggttctgcatgcccgaagaagagaaaagttattggaccatggactgttctgactggccctgatatgagcgcattctggagatcccgtccgggcgcgatgtatactgaaaaggtattctgatttattttcctgagtgtttcatatcgcccggccatatcttcaggttttcaagagggcatatgtaaacgttatccaagcagggtgaaagtgaaaaggtctgaaaagggttaagatatattcccttttagcatatccctgactttttcaatctctttcagtttcacttcgtagtcgcccactatttctgttttcagttcttcgagaatatcatccagggatttgatgaggtgatagatcatcgtcggtctgccttttccttctctggcgtgcctgacatctttcacccatttccgtttcataaggtcagatagggcaatactcacctcgggttggcgcagatcacatatccgttctatctcccttgaagttagatcatcatcccgtatcatcagaaccaggacccgggcagtatttttcttcagcccgatatcccagaataaatctgcaatttcctcttcccccttagaaaattgcaggagtgtatgagtgcccaccatagtacacctgagtaagatatgactgaatactatatcacagaaaagatataacttcccattggtatctcggtaaaaaaatccatcatgatcataattatttttatttgattataatttcagattctgaaaccatttacctgttgaattgataggtttgtcatatgtcctggtctatggggagtatttttatatagtgttgttaggaagtttactgaatagttccgtatgagatataagcaccgggtgaaattatgttattcattgtagaggctgttgcataactctcaatcgatagtacaatgaggcaaagcccataaatttcattgccaattaacgttccaaccgaatggaaattgtgctcttgaggaaacgacattttagttgtgcaacaatctctgtatagccaaattttttagacaaaactgagcaaataattcgtctctcaaagcatgaaagatattgaggaggaaacaaagggacaggtcaggtacgtaagtatctactaaacattgggttagtatgatacgcttgttttctttgagacgcctgatgaaaaaaccgccataattattgctctcaagcgaatggataggaaggatatcataactctggttgctgtgccgggagatgaaaatcatccttcaggcccgatttaattatcaccataataagccatggtagctgataatatctctttcgctagacctgatttatatatcatagtcctttttctcttttcctacagggatttttctgaattaataagagataatttttatatgagtatctcaataattgttttagaatcaattatggcagatttaccaattgcagccgtaactcgtgttgccaaaaatgcaggagctgagcgtgtcggtgccgatgcatcagagatccttgtccagaagactgaagagtttctcggagaacttgttcgtgaagcggtaaagcttgcaaatcatgcaggccgtaagaccctcaaggaagaagacattgagatggctgcagaaaagttcgcctaactcttttctcatttttcgcgggtattttggttacacctggatagaacaggtgttttgtatgaacagaccgtccgtccctgattcttcttaaaatttgagtggtccggtatcgggaagcggttccttaactcccataatccctggattcatgcggcccttttcgttatgcgttgacactctctgttctgatcgtctggtcgcgcatattttgattttcccggtcggcaaaggagaggtcatatgagtcccttctaaatcgatgttcccgactctcaaataaattgggtaattccttccgactggaaccggagtcctcgtctgctctttgccctttgctccttcgaattttccttattcaacgttcgtttgtcaactgttggagtcgggtttgatcctattttcgcttcgttaaccggcctccatcaccgccattcttaccggctatcatcgcttactctccgggagggtatttgtatcaggcttttcctgcaatccccggattttccagtgtatcagcgttaaggtattgatgaatatgattcggtcagacctgacggatgaggtgatatcaagtgtgaccgcttcacctcatatgggtgaccgagaggattgggatgaacggatcaggagttattgagctgcatccggggagcggttgctgacatagcccacagatttagggttacacgtcagacagcgtcatggaatttgagtaaagttaaaacgatgagtgataagaggattctagcagggaggtgaaattgaaaagtgcgaatttttctaatccctcttaaaaaattctactttcagtctcctgtaaaaattgaatcaaatacaataggtgattttaccaagaaaaattttatatattgtgagaagaggatgaatcatcttcatctctctttttttgacgttcaagaagggacttcagaacaaattctcggtcagtcggcaaccattgatggcgttcttttgtgtaatcgccagatccgtgttcaaaacttgaaataaacatggccatatcaattgggccaagagccttcgataatgcttctatcccttctcgtcggatttcactaatagtcttcatgattcacctccatgagccagttcacaggattggaaacagagaatcccgattgaggattttttgatataatatttattatatgatcatctgttgtcaaaaaagttgcatgagcaatcctggcacatgcacaatgaagagcatcaaaaagatgcattcctaattgctcaaaaacattcgcttgagagataatatctgaatctattgggatatattcttggatgagttcaatataattagataccgccgtttttcgttcatactctagtatgtaagatatctcttcatcaatgacaacactcccaattaatgtgtgttttccatttttacataactcaagaattgctagtactgcatctacttcaaggcttattcgttcatgtgttttattatcaaatggtctgcaataacaacagacatctaaatattctctcatattcgcacgtctttgaaagagggggccttttcttttctgttattgatatctgttctattatgctaataatctcatctttgttgtcgccctctgctccttcgtcatttccttcttcaatcttcgttcatcagctgtagatgccgggttcgatcctatccttgcccgggtagcggccaactgtatcgatgcccccatatctgcgggccctctggtcttccggggacatggtccagggattatccttggctctcgggtggggagtccttatcatcttcaccgggattagggccgtttttaatagtgcatattccccaatcagatcccatacgtctgcagatgatcatccaggagatcaaggtatcgggcatagatctcaatctcatcagccatccgtatggttgccagaatgagcacagagaaatccatattcacagtaatctctccacagaacgtatgagcatattcagacagcatatcttctatcctctgacagatctcctgttttctctgcctgatacaatcagaccggcctcatcatcgggtggcattaaatactgattttctgctcggaaaaaagaggagggaagattatccacattcatctgctttgtcctgcaagaccgactacccagaattcttcgtcatcaccctattcatatgtgaatatctcctgaaccttgagttttcgaatctgccacacccacaaaagtgagatcctcatacaggatatgaccgacaatcctatcgatacagccggaattacatactcacatcctatcatctgctccaaactccatctcctccgtcatgttcagatcaccgagagtgtctgatccatgattcatcacctggcttccatcatcactctctgctctggtcagcagaataccggtcccgtttgcatgaatcagaaaccgtgatgcattcccctgcgagagcatcgacgaatacgttccctggctcatcagccccagcacagcggtctcataccttgtgagcgtcgtattttctggtctgtcaaagagacaacctcttacttcaccggttgtattcgctcttgtcgtggaatactcaaaaattcccatcggtccctgtgatctgaccagggtattcgtccggaccgtctcaccggcaaagagatccctgataatcatggcggcatcactggtagaaagtcgttcagaccatgaggctcccggctgcacaaccgatgatgccacaaatgatgctccattacacgtgatggaagaggtgactgaatcagcaccgatcattatcggtatgaaaagaagaacgaggaggagtattcctgccctgttcaccatagcaccatcttttactaaaatcacatccgctcaggcaagtgccgggacggtatctgcccagatctcaatggctgttagaactgtaacagactcgtaactggtgacctataccttgtcccgcttgaacgtgacgttgtacagttcaccgttcgctgcatgacacttgagcgtcacactaaacccgtcctctgaactgtcatgagatccgacatcgcccattgcggtctcaagtgcttcatcagcaagaacattcgagacggttgtgtcaaacccgcctgttgacggtgctctgatggctatcctgcctacctgcttgccgtcgttattctcatacacaatagaggctgttgcataacttcaaacagttagtacaatgagggaaaaaccagattttttcccaacgatttaagttccaatcgaatggaaattgtcctattgaggaaatgacattttggttatgcaacagcctcaatagttccggaatagtattccgagctctttgataccgccggaagagtctccccaccagaggtgtagggagtgcatccccatgggttatctgcaaggatagtcccgatgatggtgtttaattctgctttgcttgccagtggggaggataattcccgcactgaacttttcacaactgattttgatacaaaatctgccattgttcgtgttctctcctgtcactttgtgactcttacctgttggaaggggatatatgagaggctgaaaagagtggagaaatggggagtgaatgaatgagatattcaggttttacgggtgatgaaagttccttatatgaaacataccgataagtggtaggctggtttaagatcaggctgtccgtgtgattgttgctgaaaaatagaggctaaattggcactcatctgtatttcctaccggatataacccgtgaatcagttcaaattgaatactacccgaatgtaaattttaaatgcaagtattgaggaggagataattcatatgaagacaaggagcgtgaaaaaagatcccggcagagaggaacagacggtgtttgcctgaatccggatctatactttcccaaaaaagggagttacatccaggttattcttcttgaggaatatattaccagcaattcccttcattcataactttacatcaataaccattatccacacccggggcccataattaccgccacggaaaatacattacaaacgaaatataatctatcatcattcaatagataggacaagaccatggcaattactattgatgcagaatataatgggacggccttcatccccatagatacggtttctcttaagaaaaatcgaaaatatcgtttgattgttgaagagacaaccgatgaaaaaaaccagaccgcatgggatatcttgcaaaatcatatcggttctatagacggacctgaagactggtctgaaaaccttgaccactacctgtatggttcacctaaaaaaacgaaaaataatgtgtctgaatgaataatttttatggttgtaccagatattctctttcttgatactggttattcgtgggtctgttaaacaaaaagatccatggcataaaacagcagcctctctgttccccctctgaaaaaggtgcctcatactataacaactgaagcaattctcatagaaactggaaatgcattcgcttcaatagaccgtgcacttgcaatttcatttattgagagttgttacaatactccttctctggagatcatccctgtgacttcaaatttatttcaggcaggattggatctttataaaaagcatcaggataaaacctgggaaatgacagattgtatctcattttcggtcatgaatgaactccatatcctacacgctatgaccaatgatgtccattttactcaggcaggttttatagcaatcatgagagagcatgagatctcaaatccataaaacttaattccggagaatgattgtcaaaacagtattttttgaaaatatttcaaaccatccgtcaataacagcaatcatatagaattatcgcttcattttcggcatggtatgatacagattcaatgagcattgtattattctgtgtcaatattgaattcaaggtatactggtatatcgcttcagcgatcatttgtaatttctctgtgtccatcttctcctgaaatgtcttgaaaattttttataatcaggaaaattggacatctacaccccccaccataacgtcaccctcttctttggccattcccggatcatccccctgacctgggtgaccagcacgacatactcatcggatatgataatccggtttcctggattctgataggttcaggtcaggaacgggaagaccactcagaagcaggataagatctccggatgggatggatctgataactccattcccaaccctgataacatcaatcataccattctttccggacctgagccgtccgatcttttatacctgacatgtgattcccgttctgatgtcacgatgaacgtcattgtccacctccgttccgggcctgttcacgcgagtaacagaccgaacagataccggtctttgtatcatgatcaaacctggaaattcctcgcatgtcacagagagaacatctgccatagtccatctgcctctaccatccgggagatattcagcgttcccggcagggcggtaaaggacaggctcaccctggcaaccgcctttgaatagcatttctggcagaggacatgggaaactttttcttcccccttctcacctgacggttgtttttcgatataatggacccattttgctccacagatggcacatggtccggagtggatgccgtgaacctgggtatatgcttcaggatcaatcgcttctatggtcagttgttcctgctctctctttaggggtgggagataatctggtccgggtggatccggatgtatgtcccgcccctcagtttttgtatcggatttggaaacgacggatggatctttctcctgttcgtacccaatattgtgaggggtgggaacagaatccgcagtgggtgacagatagacaggtgcaggtgttccatatgcaccctcatcttcccggcctttcgtattcttatacatattatttttattataagaggtattttcagattccactcctgaattgtccgaatcatgaggggtgggagttcccgtccaacccggtttttctcccgtcctcccactcccgtggtcatcgtggtcagggctctccatactggtcagactcctctgaagaatcaagccagcaccctccaccagatacccagttctggtatacctcataaatcatcggtatttgcatagaaggccggctgcccgtgtgcctaagaagattcggacctatcagatgaatgagtagcgcaattattgatctccttgggctttaattgaggttttgttcgtgatatgtggttttatatggtgaggaaccggtgtgcatggatcacctcagggatgtgattcgactttccgggtttgtcgttataaaccccaaaagttgtaggtgaattttttgcactgtcatgtctggttcgttatttcaggttttcctgcgctctccgttccgcatgggtggtttatatgtccggagttttggagagtggtgttgcctgagggcacatatgaaacgggttgatgggggggtgagatgggggtgaggtaatgtgcatctctatgaaaaaatgaatgagtaaaagagatggctgaatggaagagaggagatgcagaccggctgattgccacgctgcatgagtgattggaaccccaggtttttggttcggtgacggtagcagaaccgagtcaggtttccgctgaagcaatatttcataactactcgatgtggaagatgaagattaatgtatatttttcattcgatcttcagagttttacgggatatgtctgcagccgtatcgtgaattcctatgcttactaactggaatcaagaatatcttccggcgttactcttttttcaggagttttattgaagtcattatcatacgataaaagggtcaggttctggctttttgcaagagcatattgataagcatcatcgaaatcaagtccataagaatcagacgctcgtgctaattcagggagatattccgggagtaatgatagtattctcaatcctcctggtttaaacatgtcctttgcaaaccgaagatacagatcctttttatttttattaaagagaaaaagcccgatagagtgaaaggaaaaatcgctgattgagcaattgatatccggagcctgtagaatttgtatcacaacagaagcatgttctctttgtaacaataattccaggaggatattggtatcaaggaggtacatcaggccttcaaggtgtggattttatgttgtatctctacggtggacagggacggctcatcatcctccagttctccgacccagtcaaaagagaatttcttttctgattgctggaactccgcatttaattcctctatatattggagagcacgctctcgcaggtcctggggaagattttgaatgactgactccacctggtcaatggttatcatactttcatgaaattattgaggattagaggtaataaggtatctgtaaatatgatttcaatgagatgaggagaattctttcaaattcatgaaaaaccaatcactcgaacattccatttttcaaattcatataagcattctggtttttggtgcatcgagatgggaaagtagatgaaagaacaggagctaataacctgattaaccccgctgagatccactgttttccagacgggtagattctgcgggggttactttctttttccggtattttttcatttacctcgttgattgtgacattgactgctatagtttcacctgcccggcgtatacatgccgagccttcagatgtctgaaataccccctgataagttccaccatgcaggattaattcggggaccgcaatcctttaaaataaataaggagttccggacctatcagatgaatgagttacgcaattattgatctccctgggcttgaattgaggttgtatgcgtggtatgtggttttatatggggaggaaatggtgtgcatggatcacttcatgtgtgcgattcgactttccgggtttgtcgttatagaccccaaaagttgtaggtgaattttttgcgctgtcatgtctggttcgttatttcaggttttcctgcgctctccgtcccgcagggggagtttatatggttggagttttggagaggggtggggtagaaggacgcatacgaaacgggttgatgttgggtgagatgggggtgaggtaaggtgcatatctatgaaaaaatgaatgagtaaaagagatgactgaagggaagagaggagatgcagaccggctgattgccacgctgcatgagtgattggaaccccaggtttttggttcggtgacggtagcagaacagagtcaggtttccgctgaagcattacttcggaactacccgatgtggaaggtgaagaattagtacagagttttcggaaatgaactttcgtttccgttcctggtggatattcctgacaaaaatatatgaatgaggaaaagccggaatccggattgatctgcattcattaaagactcgcatcgaccagtcgcttttgtggctttccggatttatcataccaaaacccatgaagcggaagaacaggcttgtggaattgggagaccatcttctttcataccttcgatatgaaacgcaatcgcctcatgcatctgttcttctgcctcttcacgagtttttcctgttgccacacaaccggggagatccggggagtatgcagcataatttgtctcagccttctcaataacaatcagaaacctatacattattttccctccttgtatcctgcttgtttccagatactattcaatgttccatgtggcagtgtatctgacagttttccaggaatagtaattcggccgggtttatccgggtgtttatactgtcgatgacttacacgggtggctacaagataccaaccatctacttctataaattctataacctctcgaactttcatactttctctcctcacacaaaagccaggtaactctgaacccccacattcagatccttggctcacctccgcctattctagttcctgtgaaaagaaatgtgtaacataattggacaggcacgtcaaataactctccttccacactcacaggagttacacaggaccctatccatctggtttagaatatataagatctcggttcaggcccggaaatagtattctgccccctgacccggtattagataaataattgggctgtcccccggtttacaactggtatcacaaattgaattataattgcattaataacttataattccgaacactctcctgctaacctttaagtgattaataatatacttactagaattccgacttcttcaggttcataccattatcagttgttatcaggggtacaacccgtttttcagatatattgaacttccgagagaatttttggacggaggagaagttttaatccttcaatatctaccaggtcaacgggagcctgcagtgcttcttccaatttttcttccagctccagaaatccaaagatcctgggggggtatcaaattcaacaaggatatcgatgtcgctatctggtgtctgttctcctcggattacagagccgaacaggccaaatcttctgatatgatattggctggctaattgcggttttattgtatagagtgtttcaagaaccgaagctgcctgggtcatgttatatcatatgttcgaataatccatagttatttttactgtcctcatctcgagatcattatgaagctaaaatatataattttttagatatattacatcctatataatagcaggtgctctatggtgggaggcaatacatctcagcaactctctctggtggaagaggagattgcggaaatattcaatgatatcggggtgaaacggaacgcttcccgagtcctggttctgatgatcagggggtttgatctgacttcacgggagatagaacgtgtctgtgatatcaggcagccggaagtgagtattgctcttaatgaccttgagaaacgaaaatgggtgagaaaggtcggtcaaaaatcagagaataaggggcggcctgttctgatatatcatttagtcaagtcagtggatgacatcctcgatgagttaaaggaagtgattgtcggagattatgataagaaattacatgagattgagaaggttaaggaattgcttaaggaacgggttgtagagagaaattgacataaaaatagatttctccaatatgttctttctatttctatgttcatatttaccactggactccggatagtgagattttttcctcaataacactttcacccctcgcccctgaaattcatatgccccctcaccaatgaagtacccatgggttcaatcaatcagtattttttcagtattccggataattcattttcaatattcataggctcaaattcatttctcaataaaatgcttgataatgtaactcaaaagttcccacaccggaagatccagtatattttttaccagaacaatctggcagacttacatatttccactgaagaaaagagaaggattgaattcatagaggtggacaatgcagttgatattttggcaatgcttgaaagtgataccgccagtaaaattatcatcgtatgaggctgttgcacaaacacaaaaaaagcttaatataaattattaaagcttaattatatatattattaagatcaatatattatatgtctcatcgctataacatgattagaggatatggtaatgaacaacaatttttactccctgtcaatgcgatggactggctatctgaaaatgatattacttatggcatattagaaattctttcgattctcgatattagtccatttattaataaatatcgtgacgatggtcgcggttctgccttttttgatcctcgttcaatgcttggaataataatttattcaatgattcgtggagaaaaatctagcagaaaaattgagatgtgctgccattatgatattggatatcggatcgtcgccaataatcttacacctgaccatacaacgatctatcgtttcaagaagaataattcaaaagaaatcaaatccctttttaaacaattatctcaaattatcgtagaatccgggatagcaagaatcggtgtcctagccctcgatggatcaaaatttggctgtaatgcctctttatcagccaataaaaaattaaaataccttgaagcagagctaggtcggctttttgatgaatcacaggaaattgatgagttagaaaacgatgatataaatattcaggatatggagattaaccgactacctgagcatctttcaacaaaagaaaaacgaaaggaagttcttaatcgggctaaagagaaattaattgaacgacatgatatcgaatctaaaaaacaagaagaaaagattctggaccgcgaaaaagaagaattagaatcgggtaaaaagaaacgaggtagaaagcctttagagcctaaaaaagagccatcttcagattcaaaagtaaatctcactgatcctgaaagtcagataatgtcaaccaccaatggctggattcaagggtataatgggcagattatcgtttctgaaaatcaatttatcctcgctgcaatgatatcagatgagcaaaacgataaaaaattattaatacctatgctaaatgaactcgaagacctttttacgggtattcatccatcaatttcgcctaatatactactatctgatgcaggttatttctcatacccgaattctttagcagaattggattatggcattcaactcatcatccctccttctaaagaaagaaaaattccagaatattcagataatgatgggtatatctcacgaatggaaatgatatgtcgggcgatttgtatgggagaaataatcacatttccggaattgcaaagtatcgggacgtttgtttggcaatcttttatgaacagagagaaacaagcaacaactcaggaaatttgtaaacgagttatggaagtacgtgtgaaatcccccactggtagagagttatatcgaaaacgaaaatacatggtcgaaccagtttttggtaatatgaaacataatatgaggtttaggagtttctctcaaaaagggaaagagaattgcgagggagaattctttttagctgcattagtgcataatataaaaaaacttatcagatttgagggtatagttaaaattaaagaatttgctacgaatattataaaaccgtcaagaggttcaggtttttcctatatttttgcaaacacagtatgtaaagtgggaattgatacatgcaggttcatacatcaattagtctattttggttgatagcttaaggggtagagatcgatcatttgtgatcctgcatgatattgatcattggtgcaacaccctctgaaggctgcttcgttataggcacgtatattataggcgttgtcaatatatatagatctttctataataaaagttaactgcgtaactcctattaatttttcgtttatctgccccgttcttgaaccagatgacaccgttccggtcaaagtacggtttatcctgtcctttgggtatggtgagaatgataacgacccgatcatttccgataaagacgttctccgttttaacagttaacgggcttttgatactttgtgaggcagtgttgctaatgagctggttaatccgggatacgtcagaagaggtcagtcgggggattgttccgtcgtcagcgactccgatataaataatctctccttcggcgtttgcaaacgctgccatctctgctgccagggaatctgggctggtgatattttgtttgaactggcgggtggctgtcttcgccgagagagatttgggataagagagtgttagggatcatgaaacaaaattaagggattaatccattttattcaacaaaacattcacaaattgtttaaacattaccatagaggttgttgcacaactaaaatgtcgtttcctcaagagcacaatttccattcggttggaacgttaattggcaatgaaatttatgggctttgcctcattgtactattggtttagagttatgcaacagcctctagattctgacgagaaaagaattttttaaaatttaatgcgaggagccggatttgaaccggcgaacccctacgggattaggccctgaacctaacgcctttgacctggctcggcgatcctcgcttaataaaagactgacaatcgtacctgactctgacaaatcagagacaatcgtgcctatacagattagtgttctccaataataaggattcggaaagaatcctgaaatcccttacgactcctgatatctccgaagttccctctctctcagttctcctcgtttaattttcccagagagcgtttttggaagttcctctacaaactcaatgatacggggatacttgtacggagccgtcacttttttgacatgcttctgaatatcgcggataagctggtctgatggttcatatcctgccttcagaacgataaaagccttaatgaccataccccggatgggatccggagagccgaccaccgcggattcctgaacagacgggtgctcctgaagagcgctctctacctcaaatggaccgatacgatatcctgaactcttgataacgtcatcatccctgccaacgaaccagaaataaccgtcctcgtccatgtaggccttatcgccggtgtagtaaaatccgttcttaaacacatctgcatttgcttccggattatccaggtattcaacaaagagaccgaccggccgggggttgagattgatcgctatccgcccttcagtcccctgggggactgggtttccatcttcatcatgcagttcaatcttccagcctggcgatggtttacccatggatcctggtttatgcaccatacatgggaaagtggcaacacagcagcaggtttcactctgcccatatccttcataaattggaagaccggtctcttcctgccagattctgatgacttcaggatttaagggttcccctgctgaaatacagtggcggagagagcggagatcatattttgcaaggtcggcgatgataagcatccggtagatagtcggcgggcaacagaacgttgagatctcatatttttcaataagcggaagcagctcggtcgccttgaatttccctctggcatcgtaaacaaatacacaggcccctattatccactgaccgaatatcttaccccatccgcactttgcccagccggtatctgatgaggtaaagtgcaggtcattactgttcaagtcctgccagagacgtgccgtgacaatatgcccgagcgggtgcgagtggttatggagcaccatcttcggctcaccggtcgtccctgaagtaaagtagatgagcatcgggtcagatgcatgtgtcttttgggttatcggcatgctgattgcagacctggagaccggggccgggtaaaagagttcatactgataactgatccagtttggcagttcaccatcaatcagcatccggtgctttaatgtcgggcagaacctgcagatcttttcaaccttgtctgcattctcggtgtcagtaataataaattcaaatttacctgcattaatccggtattgcagatcctttgatgtcagcatggtcggggcaggacagaagactgcacctagtttgattagggcgatgacaaagatccaccattcagggatccggtggagcatgagcatcactcggtcaccctttttaactccgtattttataagaatatttgccgcttcaaccgagagattccggagatcccggaaggtatatttcttctcctgaccatcctggcttacccaaatcattgccaatttgttccggtcggtctctgcccatttgtctatgacatcaaatccgaaattatagaactcaggcacatcaatcctgaacgtttcaacaaattcatcatatgatgtcatctgatgagggatctcatgtttcattcgtaccaaaggttacgcgtactgctttaatataccattgaagaatgaaacgatgaattatcaccgccattgtgaaagacctttttaggtcaactatctacatgaaggattcaccgccaaattgagggaattgtccattagtattatggtatggaaaaccccatgatatctggaatggaagataaacgatacgatagcctgaagattgaaaatatagttgcgtcaggggctattgcagattcaatagatttagagataatttcaaaaaatatcgatggatgtgaactgaatacaaaacgattccctggagcggtctatcggattgaaaatccgaagattgcatcactcatcttttcttccggaaaggtggtgctgaccggcatcagggataccgactcactagacaaaggtcttcttctcattattgataagatgaaaaatgccggtatcacctgctttgatgaaccacgggttgcaatcacaaatattgtttgttcctatgatatcgggaacaagatcaacctgaataaagttgtgatgaccttaaatcttgagaatattgaatatgaacctgaacagttcccagggcttgtctaccgtatcagtgatccaaaaattgttgcactccttttctcatccggaaagatcatcctgaccggtggaaagaacatggaagatattaaaaagggtctgaatttcctcgagcagaagctcgggaacataatgtaatttttactgccagaaccggtgggtttttacaaaatttcgttccgcttttaaaatctcccgcatgagggcatcaccactcgtataggtagccaggattctcgatgcagtttctggcccgacgccttttgccgagagaatgattatcgcttttttcccgcttgagagaaccatattcgcatttctgataagcttctgttctatagctttttcttcctgattttttgtctttttatttgcaattgaatagagctcagtctcgtagggtttcagtgctgcaatgagcctggcaccacaattcccgcagaccggttgatccggaactcttgctaccacggttttactcttccatttccgacagttcatacaggcaagcagcacctcctgcctgtccagacgagttttcagtgcagatattactgcctgatcagcggttggcggaggtatctggtcacgggacgaggaaaagagggctgcacctcctatcatactgggcgggctggttacaacctgaatctcccctgcatgaatggccctcatgatcccgatcgcatgggagacatccatgtatcgtgtaaagagttcgcggtaggtctcttcctggatctggggatgagagagcagatcggcaaggcggtgaaggctcagtcgttcataatccgcatcagggtctatggctccgaacttctttgagatctgaaccagtttccacttgaaaagtgaggttcgtttcatggccagttcaagaatccccctgatgtggtcaggatcaagactggtcaggatatccctgacatcagcaacggagatctcccttggcacccggagcaggatccggtaggcatccagttcaagtccgatagtcgagccaaacctggcagacagcagtatcgacaggacccggccgattgcctcattggtctgatgaccggcacagacgtttaagaccacaacttcttcagagtattcaatcgtaaggatctggtcggtagggatgattccgtgatttttttggaccaggtcaagaaatccgtttgcaaatgcgatagaagcctggtcttctgtatatcgttcaaattccctggtccggcgaagtcttccaacctcccgtgcgatctcatatgggaccggtatctgctcaccctcccatgatggaagttcgccatcggcgtttcgtgccggttcaacggtgacttttccctcttcaagatccagaacacgccaaagctgacctcgtgcaatgaaaaccgctccggtgtgaagcgaggttataataaatgactcatcaagcgtcccgacggttctcctggtaacaatatcatataccggaaatttccgctcatccggaatcatagagaggttccctgagagataccgtcgtgccctgctggtcgtgatgatccggttcccatccctgcggatgaggtaatgttctgttaattgcccgataatggcctcaagtgtctcaacatcgcgaatcccgacagaagatttggatataatggagaagatatcgtcaatggatagttccccatattcaacagcaatcgctgcaatttggtttcctatgacatctccggcctgataagaggggataacgtcttccacggctccctgtctggcacgggatgcgatcaccagtgattcacagaggtcgtcaaaaccgcaggtaataatagtacctttggagaccttgccgatctgatgacctgctctgccgatacgctgaaccagtctgctgacctcacggggtgatccaaactggatgacatgttccacatgaccaatgtcaatcccgagttccatagaagatgtgcagatgagagtttttatctctccccgtttgaaccggtcttctgcttcaatacgaacttccctggagagtgaaccatgatggacatcgacatcaccgtctctcatcagggcatgacccagtgattctgccgttgaccgggtgttgacaaaaataagggttgatggtcctttttttgtatgtctccggacggcattcacctggctgtcaaacttttctccggttatttcaactttgatatcaagatatttcgcaaccggaacctcgacaattgagcatggtctctctccggcgagaaaaccggcaatctcctccgggttaccaaccgtggcagaaagaccaatcctttgaaattctccggcatacctgacaagccgttcaagggctatgaccagctgggcacccctcttcgtccccgcaaggtcatggatttcatcaacaattacatatctgaccgatcggagatgttctctcagacgttttcccataaagagggcctggacggtttcaggcgtagtcaccagcaggtcaggaggatgaaggacttgttttcttcgttctgcctgcgatgtatcaccatgtctgaccccgcttgtaagcccgaggttctgacaccaccattccatcctccgcagaatgtcccggtttaaggccctgagcggggtgatatataatgtggtaaatcctttgccttctgtagccagcatgccgcttaataccgggatcatggcactttcagtcttgcctgttcctgttggtgcgatcaggagcagatgatctccctgtaaaatctttggtatcgcctgctgctgaacttcggagagttctgaaaatccccggtccctgatgacatccagtatccgggtatcaagctggtgtgtctttttcataggcaagatgggagtggagatctcctgcatatgttccatctggcagcagaatctctgctgattcaatgtggagtgacctggacagtggtgagaagggggatcggaatgtcttttctatcccatatccggtcagttcattacatgatggaaccatcaggagtctggtccttccctcttcatcagggtcttgtgtaaatatatgctcatctatctctcccaggataaaacagggagacttcaaggcaactccgacctggtctgtcagtgataccactgggtgatgatggccgcacaggataagatgaccctgaaggtcaggatcaggaattgtatgaccatgcaggatccctattgatcctataagagacccttctttcttcctcaattcttcaggctttaaaaattcctcaattcccggatcatgattccctggagtgacgataaaggggatgatctttcggatagctgaaaagagactgccgagttcaaaaaactcctggtacgatgtccccggaatacggtgcttaatgtcacctaggatcaccatcagatcaggctgtgcctcggttatgagatcacagatacgacgaatacgatcctgcccacgggttctgatatgaaacccatatttttgcagttcatgctcaatacccatatgaatatcggcaagaaaaaggatcctttgttcttcttccaccagcacacctggaccagatggaaaaaattcaatattcatcagatttgtcagaggagctttatatatccgggtgccggttgatagacttcatcttccgctacaagatttcgaatggtatttctgaccagttcatcagcaagggctgcacgccgtgtgtatttctggatgtcgtcgatatgaatcccgcgtggacctgaatattcctttattattgacaggataagttctgcaggatccacaggtggtcctggttcttttataactcccagtgctttctccgctcgttcagcaaatcctgtcaaatgtccgtactggatatgatagtgggtttgtgcttcccgcatttcttcattcaaatcaccggaaagaagaccttttcgcagttcatgaagccggttaaggagagaaccagccgcagcttgaatccatatatcccggtcctgctttgttgctattctgcatgtctcaactatccatcgtatcgttctgttatctgatcctgtatttttctccggatgggcagtaacactcagaaacaagggaggaaccagatctgcgggttccagagagtcgagtgtctgaggttttattataagactgactgctccggttgggtctgcaatcctgatgatttctccctgtctgccaggttcatagctggtcagagctcccgtaagccaaatcttctgaatattacctccggtaggtgtgaggatacgggagagctgttctttttgcgcaatcaggtaatcggtctgttccagttcaaatgaaaatatgggaatatatgccggaagcaggtctggtgccgcatttgacattctgatatgatctgtaagtgtcacgtatgtattttttataggtggtactgactattagatgcattggtaaagccctgcgcttgctgaaacatgtatgatgtcatgaattatggaaaatagcgtgtagtcatggctgactggaatacgacaaatttataagctccctataaaaatggaaaaattttagtaatttagcctaaaacggataaataattaatattttaagacgactatctgaattaaattaaattggcccaagcagcgtggatcacatatatggcagtattatttttctccaattgaccagaactttcgatatgtttttaattcattgtgagatatacttgcgtatacataactttcgatcgcgggtaatttgtatgatggggaatgcgaagactgtctggtgcctcattctggccattttcttaatagcaggtacattcgtatctgctgatgagaatgcgggagatactcaggcattacagacaaagctggcttcaatgccccttgtttttattcagaacaacgggcagtttgaagataatgtatcgtaccagacccagtcaactgatcaggtcatttcttttactgatgagggtatggaattcagccataatcccggtaacagctcagtattcatgctcctgaatgggtctaatccagataagaagatcatcggtctgaatccattgaatggaacggcaaacttctactatggttctgatccgtctgcgtgggttattggtgccatgctgacatcaggagtcaggtatgaggatgtttataacggtattgattatatcgtttccgggactgaaggtcttttaaagagtgaattcatccttgatgcaggggcagatccatcccagattatgctggtgtatcagggtcacaccggtatatcattgaatgagacgaccggggatctggttatagagactcctgcacgacagattattgatgaagcgccggttgcataccaggaggtaaacggcacacggactgaggttgagtgttcctatgtcctgggtcctgatgcaaccgtcacctttgcccttggggagtatgatccatcacttccactggtcatagacccggtactgcggtattctctctattttggaggggatggccgtgaccaggggaactcaatcaaggtcgataaggaaggatatgcatactttattggaacctcgtggtcagatcatctgaagtatttcaaaaataatgcaaaagatcctctctcaaatcaaaatccaccaggaacccagcaggccctgagttctggggatgtatctgtggaaggacttgcaccagggagtatacagccctactttggtggcggtgaaaaggatgcgtttgttgtaaaagtgaatcctgacgggactgaccttgtatacatctcctatcttggagggtccggaactgacgaaggtaccggccttgtcattgatgaagcaggaaatgcatacattaccggaggaacgaattcgccaaatttcccaacaaagaatccctaccggaatgctcttgcaggcggatatgatgcctggatggcaaaactggatccgaccggaaaggaacttgtcttctcaacatacttcggtggagtccatgatgatttcggatttgacattgacatcgataaatctcacaatgtctttgttaccggtcagactgcatcatggaatttcccggttgtgaaccggtatcagctctcaccatacggcggtcttccggatgcctttatcaccaagtttaccgctgagggcaactccattgtgtactccaactttatcggtggttcagcgtttgatgcaggaactgccgtatcagttgattccaatggatatgcctgtattgtaggtcagactgaatctccgaatttcctgacaatcaaaccatatcaggataaacttcgcggcccgttcgatgcttttgttaccaagtttgatccagaaggaaagtatccggctatgtattccacctatcttggtggttcagggacagatgatgcacgggatgttatttccctgccggatggaagcctcatcgtcgtaggtattaccaaatcaaaggatttcccgacggtaaatgcacttcagggagaactgaaagggctccaggatggatttatcacaactctgaacgctgatggctcggcacttacccagtcaacatactttggtggttccctcatcgactcaataactggtgctgcccgtgataaagatggcaatatttacgtggtaggaaccacgaactcaccagatataccggtaactcttgcataccagtccaaacccggtggcagttctgatgtgctgattgcaaagttcaatccagccataagccagattggatatgccacctatcttggtggtggaagtatcgatgaaggtcgtgctattgatgttctgcccgaaggagaggcatatctgaccggttatactgaatccaaaaacttcccgaaggtatggccatatcagcagaactttggtgatggagaccgtgatgcattcatcgtctccctgtcagaacatgatatgataccggtcacagactttgaaggtgttccgactgaaggtgatgctccgcttacggttcagtttaccgataaatcacttggtatcccgacttcatgggcctgggagtttggagatggtggaacctcaactgagaagaacccgcttcatgtctatgagaaaccgggtgtctacaccgtctctctgactgcaaagaacattgtatctagccagaagaagacaaaggaagattatatccacgtgtttgaaccggtaaaaccaccagttgcagacttctcagcaaaccccaccgaaggaatggtccccttggcagtcaccttcacggatctttcaacaaatgatccggaaacatggtcatgggtatttggtgatgggggaacgtccactgagaggaacccggtgtatacatacaataatccgggaacctacactgtgaacctgacggtcagtaaccgtgctggagtatcctccaaggagaagccggagtttatccatgcaaagcctgcggttatcccaccggttgcagacttcaatgccaacccgaccagtggcatggtcccgctcgcagtaaccttcaccgatgcttcaaagaatggcccgactgcatggaagtggacctttggtgatggtggttcatcagccgaacagaacccggtatatacttatacggtgcccgggacctacaacgtcaccctgaactgcagcaacagtgccggttcagatgagatcacaaagcctgaattcatccatgcccagccggcagtcattccaccaaaagcagacttcaatgccaatccgaccagcggtatggtcccgcttgcagtgaccttcaccgatctctcaaagaatggcccgactgcatggaagtggacctttggtgacggaggctcttcaacagagcagaacccggtatacacctacacggtgcccgggacctacaacgtcaccctgaactgcagcaacagtgccggttcagatgagatcacaaagcctgaattcatccatgcccagccggcagtcattgccccggttgctaaattcaaaggtgaaccacggaacggaacagctccgctcagggtaaccttcaccgatctctccgagaatgggccgaccagctgggagtggaactttggtgacagtcaggtctcaaccgaacaaaatccggttcacgtgtatgagaaagcaggaaagtacaccgtgtccctgacggttaagaactctgccggaactgacactttggttgaacaaaattacatcatcgtcaatgaaccggttcttccgccatgtgcagacttctccggtgctccacgggagggaaaagccccgctcacagtgacattccttgacctctcaaagaacagtccgaaacagtggtactggaaatttggagatggaacaacctccgaggaacgaaacccggttcatacgtatccagctgaaggaaaatacactgttgaactgacggtcagcaatgaaggtggagcagacaccaagattgcaccagattacatcaccgtaactgctccgggtttcccgcctgatgcacaattcagaggattcccaacctccggaaccgcacctctgaccgtaagctttaccgatctctctaccggagatccgaccaagtggagttgggattttggtgacggatcagtatccagcgataagcatccggaacacacctataccactcccggagaatactcggttaccctgacggttgagaatccgtttggtatgtccaccgaacttcgtgagaagtacatccgggtgtatgaaaaaccagttccgctcaaagcctccttcatgggagagccaacctccggaaaggaacccctgactgttcagtttactgatctttcaacaggtaatcctgaaacatggatgtggaactttggcgatgatcagacctcaactgagaagaatccagttcatgtctataccaaggcaggtgtctatactgtattcctgacggtgaccagaggagaggatcggtccagtgagatcaggtaccagtacattaccgtccttccggctggaaaaccaccggtacctgattttgttgcatccccgacaaccggatatgtcccgcttgatgtgcagttcacggatctttcaaccgacaaaccaaccgcctggagatgggacttcggtgatggacagtcctcatcagagcagcacccggttcatcggtatatgactcctggatcatacaccgtctgccttgaagcctcgaatgagttcggctctgcagcaacctgtaaggataacctgatcaaagtgaccgaggcaccccttgctccggcagagttcttcggtagcatcaccgttgatggaagtccgggatgtatcgggactatcatcgaggcacggggaagtggtattgataccggtatattcggtaatcctgtcacaaccacgattgaaggggcctatggaacaccagatccgctcaccgtcaagggaacaataaagaatggagatgcaatcactttctgggtaaaaccacagggcaaacaggactttgtccaggcagaatgctatgatgtgtatgccggtaaggaatggcagaaatcatatccatacaagggtggttcaaagacccggctggatcttcgtgtcggagaagcacccattccgccaatgccggtgctgcctcatgagttctatggtgaagtaacatcgaacggtatgccgatgcctgttggaaccatgatcctggtaaagggtgacaatgtggttgaaggacatcgtggcaatccgcttgctgtcacctcacctggtgtctacggatttaatgaactgaacaaactggttgcacagggagacctgaaagcaggacagccactcaccttctgggtaatcccggcaggttctggtgagccggtcatggcacaggtcagggatgtggatgcaagcggtgaatgggcaagttcatatccatatatcgagggaggacttaccagacttgatatccggattgatggaggaacccctccaattccggttgttcccatgaccatatccggaacggcccttgttgatggaaaccccatcacccccggttccctgataaccgcggacgggaagaatgtcagagttggtattgatggaaacccggtctctgttgggaacaatggacggttcggtgatgggagaaaactgacaattcaaggtgatatccagaccggaagtccgatcactttcctcatgtatgatgcagcatgtggcaatcagtatgtggcagaggtaaaggacccacagaccggaatctgggttgcctctattcctttcaagccaggtgcagatatggaacttgagattagatccagttctatcatcccggcagataaaaagagtaacgaaactccggtaattactgcgtctgtccctgaagatgatcaggttcagacacagtaaaaattctaacatttttcttttctttctgttttcttttttaacgcatcatcctccagggatctcttaatgatccacatcatattccttcaaatagaactatagcataaaacgaatatggcttttttattcgtgaacgtgcaaaaagggtatatccccctcattattgcaatatctctcgcaacattcatggcgtcccttgacggaacaatcgttaatatcgctcttcctactatatcagaatccttctcactctcctcaagtgctgtctcctgggtagcgaccatctacctcctggtaatggccggttgtgttctgatctttgggaaaatatctgacttgatcgggtttaagaggatttttttaaccggctttatcatatttaccatcggttcgttcttatgtgggtttcttcctgaccttaccggttcatttctcactcttattggttcacgggcattccagggtgtaggtggtgccatgataactgcgattgccccggcaatggttacggcattcattccaatgaatatgaaaggaaaagccatgggcattatcatgacaatggccggacttgcaactgctatcggcccgaccgtgggaggatttctgacccagtatctctcgtggcactggatattttttatcaatgttccggtcgggattatcgcattactgcttgggttacgggtgattcctggtcagccatctcaccagactttggaagtatttgacaggatcggtgctggtctgatttttgtgggccttgcatttctactctatgggttctcagaagggacaaatcttggatggacgtctccagtaattatcggatctcttgggcttgcagttgtcttactgggattattcgtatggaaagaacttcatattcaaaatccaatcctggagattaggctatttcatgacaagaattttctgctcatcaatctggtaatattcctggtttttttcagtttttcaggagtaaattatcttcttcccttttacctcgaatatgtaggcggatattcaacgtcagaagccggactcatcctgactgccctctcggttgccatgatggttgccggcattatcgccggggtgctgtataaccatctcggaggtcgaatcctctctattatcgctgccgttgttttgcttatcggctatttccttatcactcatttgcggatttacaccccgaccatctttgtcacggtatgcctgctttgtattggattcggacttggtcttattattacccctatatcaaacatgatcatgaccagtgcatcaaagaagtaccagggtatggtctcttcactcacaagtcttgaacggtttgctccgatgaccatcgggatagcgatttataatgtaatttttatccaggggatgacgaccatagcagcacattatgatattacaaaaaatgccccggtcgaaattcagatgaaggtgctgactgccggatttgatctggcctttctgctctcgtttatcctcggtatagtaattctggtcctcaccgtcatggcacggtatacgatgcatcctgattaccagggtgaggatatagataagatggctgctggactggtctagaaaaaaagtgaataaaattttcaggtaattggaatggtatacacctgctcctttgcttttggttcctttttcgggatggtaagttctaaaattccatccttcatggaaccttcagccttctctgccctgacttcttctgggaaatgtacttcccgtttccaggttgaataataccgttcacgatggagatagtttttctctgatttttcgttgtaagattccttctgggccttcaggatcaatgaatcactggtaatctggacttctacatcatcctttgtcataccaggtaattcgacctgaagtttatagtgatccccttcatcgatgagatctaggggtgcataatgttctcttccaaattccgctatatctttggggagataatcgaatgggaaatatggccgcatcaggttatcgaaggaccttcgaaaatcttcgaatatggaatcgaagtcatcaataaatcctgaccggtgctccctcaaggcacgggtttgtggtgatgagggagtaatttctgttcctttttgttttttaaagaggctcataatcgttccctcctttgcacactttaagttagtctttaattttatttatatttttctcttttcgttttgcaaaattttcgagtgatcccctgaactcctcaataaaggtcccccggtcaagaacctcaacttcctcctttctgatagcaccatatcgcaataacaggagaagtgaaaaaaacaatactgaaaccgtgagtatagtaagaggattaatctcaagaattccatgaaggattatctcacgcagtatggacacgattcctacttctatcatgatatcaactgcaatacggtgctcccggatatagatgataaggaggcggtaaatttccacaagtaccagaatatagatcaattctgatgcaacatactgaaattcaaaaggttgtgccagggcgaagtacatggacagaagcgtcttcaccatgagagcgaatagtaatccacacgtaccgattacaatgatatcctgaatattttcaagcaatcgtctgaaaagatcatgaattttattgtatgaaatacccggcatacaattcacctcagatctctttccatattttatccttatgtactacatatttatccttttgtaaggcaacctttactttgcatcgtacacctcctgacaatcaaagacaaaaaggtccggattattcttcaggagttcaattccatgaacgcagaaattcagtcacttacaaatcaggcaaaagagtgtgcggatctcctcatccctctggaacatgagatctgtcaggttatcgccggtcagaaaaacatccttgaacgacttatcatcgcattgatcgcagatggacatgttctattggaaggtgttcctggtatagcaaagacactgatgataaaaactcttgcacagtgcatcgataccggtttttgccggatacagttcactccagacctccttcccgccgacatcaccggaacgaagatttacaaccagcaggactgcacattcaaaacggtaaagggtccggtatttactcagtttcttcttgctgatgagataaaccgtgccccgccaaaggttcagtcagcacttcttgaagcaatgcaggaacggcaggttaccatccaaggtgagacgtatgctcttcctgaccccttctttgtccttgcaacagagaacccgatcgaacatgaaggaacgtatccgcttcctgaagcacagatggatcggttcatgtttaaggttctgatgggttatccgtcaaaatcagaggaacttctcattctggatcggtttaccgaaggagtctgttatcagccaaaaccggtcatctctgcttcagatatcaaaaaaatccaaacggtggttccctctatctatgcagaccttgagatcaagaaatatgtcacatctcttgttgatgcaacccggaatccgaaagagtatcaaatccctcttgcttcctatatccggtatggagcatcgccccgtgcctctatatatctgatgttgggagcgaaggcacacgcactcctccggggaagaggatttgtcattccggatgacgtaaaagcagttgctcatgatgtacttcgtcaccggatcctgctctcctatcttgcagaggcagaagagattacggtggattcaatcatcgatcagatcatacgaacagtcccggtcccctgaagcggtgaactatgccggataataccagctattcggatttgattcagaatgtcaggacaattgatatcctgaccagggcacgggttaccggtcagcaggccggagtccatatctctcttttcaagggacagggtgttgaattttccgatatcagggaatatattcccggtgatgatatccgtgccattgactggaagataactgcccggtatcaaatcccctatgttaaggagtttgttgaagaacgtgatcatactatctatctgattgcagatatctccggttcaggaacttttggtcacgtggtctcaaaattcagcactctggtctctgttctcgcaaccattgccttatcagcggttcattatcacgaccgggtagggctgattctggtatcagacaaggttgagaagttcattcctgccagaagtggtagaaaccatgttattcaccttatccagtcgataataactcatacatcgcaggccggaggttctgatctccgcccggctttgtccatgatcgtgcaaagggtccgccggatgtcgaccgtgatcctcttatctgatttcttcactcctgactgttcaaaggagttatccatggtgaaacgacatcatgatctcctggcgatccggatctccgatccccgtgaagaagagcttcctgatgtcggactgatagaactagaggatgccgaatcaggagagcagattctggttgatacatcaaatcctctcgttcgtgaggaataccaaaaagcaacggctcagcataccgagaagatttctcttatgatgagaaagcacaggatcccattcgtcaatatcagatccggtgatgattatgtccctatccttaagcatctgatgatggcccgtccgggaggagaattatgactgggttttatcatcctgagtggctgattgccctggttcttctgccctgtctctattattactatgaatatcagacaaaacgaaagaaacaggaagcaatcgtcttttcacatatcgggtttttaaaaagtgctcttcatgggagtacgcaatcttcccggccacggactcttctcctgcttattcttgcagctatcggatgcatcatcatcggacttgcggatcctcacataccccttgaacagacaaaagaaggggtaagtgtggttcttgttctggatgtatcaggaagcatgcaggcaaccgattatcagccgaccagactggaatcttcaaaacgttcagcagagattctgttaaaatcccttgatccaaaggattacgccgggataattacatttgaatcaggtgccaccagtgcagcctatctctcacctgataaggatcgtgtaatcagaaaactgcaggcaatcgagccaaaggagggagcgacagcaattggggacggtctggctcttggtattgatatggctgaatctatgccaaaccgtaaaaaggtagttattctgttatccgacggagtgaacaatgccggtgttatccatcctgaacaggcggcagggtttgcacgggagaagggaattcaggtgttcactattggtatgggttcagacagtccggtcgtacttggatatgactggtttggaaatccccagtatgcaacacttgatgaagcgatgctccagcagatagcagcatctacgaatggacagtatttcaaatcagtcgacgatcgaaccctttcagagatatattcaaatctgaacaaagagatcgtccgtgagaaagaggataccagtatccgtgactggttctatattgccgcactgattctgatttcaggagagatattcctacgatacggaaggaggaggattattcaatgaatgcgaaaatattcttgtggattcttgccggatgtatccttatatccggatttcatgcagttgcggatgatatttcaatgtcatctgcacaatcagaatattattatcaggttgggaccgatgcacaggttccctttaccatagagagttcatttccgaatactctgattggaacgcttcagtatagtctaacccggcaccagaatgacggtggtttttccatatcacagaccagtacacagtcccagtcctttccggtagctccgggcagatcgaatcatggcctgactcttacttcagaaacagaaaccgattatgatctctctctgctcctgctgtatgaggataagggaaaggattatgcggttgttcttcctccactgtcggttcactttgtctctgatccaaaaaaatataatccacagcagaagactgttcgctcttcgacatctgaagcgacgaagactccctcatcctcttcacagatggatccatttacccagatggaacaggagatgcagcagataagacagcaacaccagcaactgatgcagagtttcatgtctcagagtatgacaggatcttcacggtcttcttccgctgcacagaatccctcgcaggctttacaaaataatcagatgtcttcttcctcttcagcattacagcagcagatgatagaggagagtcagcaaaatgaggagaataggcggaaacttgcagattctcttgagaaggatccccttatcaggcagcaggcatcagatcttcgaaaggccgggtataaccaaacttcagggcggatagttccgaccggaccagataaaggagaggtcgctgtcagttttgagaatgataacggggaaaagatttctgtaacaggaaaggcagaagatgggaaggtttcatcgctcaccgctgagaagagtggagaaattcctgttcctccgacactcagctcgaacagtacctggaatgatctaaaagaccagttacacaacagttcgatggtgccattatcgggatcggtgaccaggactcctgaagagacgacgatcaggcagcagtacacaagtccggatgggagaaatgcaaccctgtctgcccggattgtaaatgaaaccgtggaagaagttactctgcagcaggatgatgcgtttcccttattctggtttatcggaatattgttggttattcttcttattgtcctctgcgccggagttgcctggtggtatctctccacccgcccggagccaaaaccatgcgaagaatgtgtgattccatcgaaagattaccatgagattgtgaatgagatgctgagcgatgcagaacgtgcctatcatgcaggagagaagaaagaagggtatggcatgcttggtcaggcaatacggacctatatttcacatacttatggaaaaggagatgccctgaccagtgaggagattatatccggctcccccggactgattcttccggaaaaggagaagataattgagattttgacatggtcttctcttgttgaatatgcaaaagaagaaccactggatgagcagtttttcggatttctctcacaagctcatgatctcgtcaggtttcagaaaagtgaagactgattcctgatcaaagcatccaaatattttcagggttcaggaatagtatggggatatcacccggagatgaaacgatatgccaggtctgtgggaaacctgcaatcggtcttgaaatactcggatgttgtaaggtggtggtatgcgaggatcatgctagttccttcctccgtaatctctcatcaggagaaaaattggagtttggagcctgttattatgtcagatattgatatccgcgtacaaaccagatatggcttttcagaggaacgccatggatgatgaaaataaggatttgacacttctccttttaataaccgccggaattgcgatatgtggattttttctcttctcttttgcccagacgatatttatccctgatctgaaggtcaattcatatgatgtctccttctcatgggatggtacattacaggaatcatatctctataatgttcatatatctgattactatagaagtctgaaccggaaatttgaaagtccggtgtatagcacgattcgttcagactcatatatccggtttatatcagtagcgcctccctcgggaaccattgggtatgtgaaagaagctgatggaaccgtaacccttaccggtgaaaatacaggtgcccgttcaattattactgaccgggctggaagaaatgaagccggggcattcaatccagggtatttccgttcagggacgtacctgatatcgtatacgtgggatattgtacctccggtagaacgggggactgatggggaccatctgaatattgatctggccacaactcatattccttatgattcagtcaggattcagatcccggcacccggtgtgaccaaactctatcctcatccggcagatcttacggttacccgatctggtgattcatacatcctgaccggttcagtatccgaagatattccactaggatttgaagtgctgatagatccctcggtcaccgcatcactgaacgggcaggtcagacctatatccggttcagtcagggaacggacagagcaggcaaacccctggtatctctcagtagcaaatcccctgtaccggctgatatccgcactctccagtctgctgctctttggtattcctgtccttctgcttggtatctggtacaggtatggccgggaaaaatcctatactgtccctgatcacctgagttttgttcctgatccgtcaataaaaccctggcttgtctctcttgtcttctcaggagatcctgggaagtttccagaagaagggctccatgcgacattgattgatctccatcgcagaggcatcatctcaatacagcagcagtcagagaaggacttttcaatccgggtattaaagaacgggaccggtgatagatacgaagagcaggtgatcagaacattatccctcctttcagaggacggaattgtgacaaatgagacgtttacccggatggcctctgatgccaatgcgaatgaatcaatgaggacccaactggttgagtttcagagatcattccgggaccttccaaccggaatcgttgatcagatgatctctgcttatatcaggaatggtcatacccatcttattccccttctcatcctggctgtaggtgtattttttgtatccctggtgctgatcatcatcggtccgggtgatcgtctgatccttggtccggctgtctatcatagttctttaactattctacagatgattatcgccctggtattcccggtatctctctttggaacctggaaggaggattactaccgggatcggttacaatgggagtcattccggggatttctttcagactcggtcatgatgcagcggtactctccggaggatatatccatctggggagactggatggtatatgggaccgctcttggtgttggtgatcaggtatcaaagacgcttaaatcattaaaaattcatgttcctgatctcccatccggcgggtggtttgctcctgctctcattcacaccggattttctcctatgcttgcctattctcccccttcatccgggtcaggcggatcctttggaggaggaggttttggcggcggcggaggatttggtggtggaggcgccggcgggtggtaatgtaagaaacacctatcttccggtgcagccaataatatacggaatttttgaggaaatattgtgcaagaggttaccagcagttttacgcccagggtaatagaagcctcggttcagaaattctggacacaggaggacatatatgcccgggtacaggagcagaaccgggatggcaaaacatggtttttcgtagatgggccgccatataccaccgggcacattcaccttggaacagcatggaataagatcctcaaagacagcattctccggtataagcggatgcatgggttacatgtcatcgatcgtgccggatatgatatgcacggccttcccatcgaagtcagggtcgaacatgaacttggctttgaaaataagaaagatatagaggctttcggtatcggcgcatttatcgagcggtgcaagcagttcgccctcagccataaagacatcatgtcagagcagtttaaatctctcggcgtctggatgaactttgatgatccctaccagaccatcatgcccgaatatattgaagcggcatggtggacactgaaacaggcagatgagaagggtctcttagatcgtggtcaccgggtagtcaactggtgtccccggtgtgagaccgccatcgccgattctgaagtggaatactgggatgaacaggatccgtcaatatttgtaaagtttccgatccatggtcttatgaatgaatatctggtcatttggaccacgaccccatggacccttccggcaaatgtggccgttgctgtcgataaagatttcatatatgcaagagttgaggcaataaaagaggggaaaaaggagattctctggatagcaaaggatcttgtcgaaccggtattaaaacgggggaaatatcaggattattcaatcctctcagaaaagaccggagaggaactggcaggaacaacgtatgattcaccacttgctgatctcatccctcgacagaaagagatcgtgcatacggtggttaccgctggatttgttgagatggacaataccggcatggtccatatcgcccccggacatggatgggacgattatctccttggtgtggagaaaggccttgatgtgttctgtcctgttgacggagccggatactataccgatgaaggcgggatatatgccggtcagtttgtccgtgatgcaaatgagaagatcctatcagatcttggtagtcatttgcttgggaggcagaagataacccaccggtatggtcattgctggcggtgtaagacccctatcatctaccgggctactgagcagtggttcatctctgttccgaagatgaaagagaagatgctctctgagatcaaggcgacttcatggtatccggactgggccgggagtgcccgtttttatgattttgtctctgatgcacgtgactggtgtatctcacgacagcggtactggggtatcccgattccggtctggcagtgttcctcatgctctgcccaccgggtctttgggacggttgcagaattgaatgcagcagccgggagcaatctcactgatccgcaccggccgtatgtcgatgagataaccgtgccctgttcctgtggcgggaccatgaaacgggtagaggatatctttgatgtctggtttgactcggcaatggcatcctgggcaacccttggttttccccggaatgatgccctgttccatgagatgtggcctgctgactttatcactgaagggcaggaccagaccagaggatggttttactcacagcttggtgcctctacgattgcctttaaccggtctccctataagagcgtcctgatgcatgggtttgctctcgatgctgatgggcggaagatgagcaagagtcttggaaatgtggtcactcctgaagaggtggttcagaagttcggtgttgatgttctccgtctctatattctctcatccaatgcaccatgggaagacctgaaattcaactgggacggggtttcaaccgtaaaccggacgatgaatatcctgtggaatgtgtatcggttcccgcttccctatatgattcttgacgggttttcccctgcccagacatcagacgggaagtatgatgatgagtacatcgttcgttcctaccgggagatgccggagattgaccggtggatcatctcacggattaataccattgccagatcggtttctgcagacatggatgagtaccaattgcaccgtgtcacccggcttttgatgaatttcatccttgaagatctctcccggtggtacgtccagattgtccggcctcgtatgtggcttgaggaagactcacctgacaaaaagtttgcatatgagacgattacatactgtcttcgcaccctatgcagacttcttgccccgtttactcctcatatcaccgaagcaatgtatgagaatctccggctgcctgaagatccggtatcagttcacatgttgaaatggccagcaggagatatcaggcttattgatgagaatcttgagcgtcggatggatgttgtccggaaatttgatgaagcagttgcaaatgcacggcaggcagggaagagaaaacttcgttggccggtgcagaatgtcattgttgtgacgtcaagtgaatcggtcatcgaagctttcaggtcaatggaagatctggcaaaggatcgagccaatacccgaaatattgaggttatccagggaagctgggaacggatgcgattcaatgcagaaccggtcatgaagaagatcggaccatcatttgggaagaaaggaccggttgtgaagggtctgattgaggctgcagacgggtcagccctccgaaagcagcttgaggagtccgggtcggttacactgagtgatggatctgaggagtttgtcctgaccgctgaacatatgaccttcagtcagcatcttccggaagggatctttggtgcagagatgaccgatgcgtcggtctatgttgatacgacgcttactgaggatcttgaagctgaaggatatagtcgtgagatcatcagaaggcttcaggagatgagaaaacagcttgatctgaatgttgaggataatatcgtgatagatgctgttatagaggatgtgcatctgcgggagctgctttcggcatcatggctggatctcataaaacaagaggttcggggtaaaacgctgaagattcatgactctgtcggtggcagggatggatcagtattgttccagcttgaccgggattgggatattgaaggagtgaatgttacgctagggatatctctggccggatgagatattccttttctggatctcaagtaacgataaaattattaaaacactcccttttttttacaggccattcaaatatctcttccataaaagaaattggtgtcggttcgattgaatagttaatggtaaaaacatggtggtctggattttcaaaaggatgcatatgccatgagtcatggatgcaatctctggtaaataatctgtttgacctgcttatcaaaaaaaagtatgttgttccggatatctcatggggataaaattggatccatatgtcttcaagaatatcaaccctggttttttactgaatgatcagtcagatgaagtatttctagaggcagagcacagaggtctgcagcatcctccatctttccaacaaattcttcgattttcacgaaatcacgctggattcaagaattgagaattttcttttcattgattctataccatcaactgctaattcccaatcacaaaaatcagattcagcttcaaatgaataatctggatcttcttttattttttcctgaaatgattggaagtcctgttatatttatgatgaaaatatgtattcatgcattgatattgtgtaagacgacatcttatttcttgtaatatgaatatttttaccaaatcattttctttcccaggaaaaaaatccgatatatctcctgaacctgatttgagagaacaagagacatacccaatatttttattcctgtgatttaggaattatggtctaccgtcagatgttgttggccgaaatattttttttgaactaatgactttgtggtgtttgaaaaaatttaattgctttggggttatctctggatgggtaaagaataatctcaaatctttaatactttaatctaataatacctcgattcccggacaggagaggaaatgagaatcccatgttatcattttccatcaaatccaagtgaggttgttgttaataattcatcaagggctcctattcgggaacccttctaatgtatggtgtttatcagaattttactaatattgcaaaatcgctggtaaccgggattacctcaatattctctttaattgtctctatctcctggattttttttcggatgagctgatcggtaagctcctgcagttaattcaaaaatagaaattactgaaatatattgataatccccagattgatacaagtatttagaatttcaggtgattttttatctttttgaatgagcccgagcagatgtgatgtatcgagtagtggcattataacctgatatcttttggatatttggcccggctttcttttatgacatcttctattgcatttgcaaattcattatccgggtcaagatctgaaaaatttttagataacgtcttctattttggaaaatgttttatgattacttttgaaaatgattcattttcggaggtttttaaagatcgcagactttcttatgccttttctctgatgctgattgtttttgtactcattcctctctaatcctctatgtgtgtatgtgtatgcagatctattaactttagagaatagctaaaaacctcacctttttatcagtggcgatcgaataataatagtggataacttttgcacgtctatttttcgagaagaatataaaaaatacaaaaaatcgggcgacacactttcaaaaattagtgattctatcgactgggagcgtttagagagctaatctcacccctttacaaagataacaaaattgatggtggacgtccccatttagatgaaatagtgatgattaaaaccttggtattgcaacatctctatggattatcagattatgaaatcgaacgaaatatttatgatcgaatgagctttcgtcattttttaggttttccagacataattcccgatcgttcgacaatttggctattcagagagcgattaataaacagtaactgccttgatttaatttgggaagaattacagcatcaaatagacaaattaggatttggaattcatcgtggagttccaggtcatgctaaaaaagataaaccgagaggtgatgaagctctgactcgacgatcaaaggagggaacatggagtaaaaaagggaataactcctatttcggttataaaatgcatacattagtagacaaagaatttatgattattcgagaagttggaacctcgacggcatcacttcacgatagtcaaatcgatcttactgaacccggacaaacagtttaccgcgataaaggatattttggcgtaaaacccaatgcatcaatggatataactatgcacagagcaacccgagatcatcccttgagttgtaaagaaaaacgccgaaataaagcaatatcacggatccgctctcttggtgagttgccatacgctgtgatgaaacgaatttttaagggagggcatgttttggtaacaactattgaacgtgtacacgtgaaaaacatcttttcctgcttttcttacaatttatatcggctgaatagtgttcaaataactatgtaataattgcgatagctatcgttctaagcgaaaaggatgggaaagaatttgcttcttttgtgatttttttgcatattttcagttttatcacctctcatatgatcatatgttgtcgttgtaagatcaaaaataggggttattagctattctctttattaattttcgggttactgaattcagtcttggtaattataagatacgataaagaggatatcattcgccttggaaatatttatatcactgtaattatatataaggaacctcatcactcggtttaatcatgattattgacctaaattatcagcattctgatggaggatttgatacccctcaattcaatgcaaagggacttgacggaatgggtggagtgccaaatgcatactgggttgttgaaccagatcttgtgcttgatccgggacggtaccagatacttgattcaggcagttccacctgggctcagaattcagaaaccgtcggctggggaattacaaaggtctggggagttgtcgagtaaaggaaaggcaattttccctctgttcttcttgatacggtgatgtcggattttttatataattattcgttcaataaaatctttaccgtccggtttcccaaataacggtatatccttgtcaattgtcactacccttctcgttgttatcgtcttttcatccgtcttcggattatacccttccttctcgaccacggtccggtacaccagaataccccgccgttgccaggcgggagtcatggcaagattaactcctcgctgaaaacagaattcatgaagctctgcagctttcattgcatggagcatagatgctgcttcctgtgaggtatacccttcatctttcagtaatttctggctccatccgttcatgtggtttcgccatgcctcctgttgtctccaggagagatagggtaggatatgatccggagtgaccgggattattcgtgcatcaaaagagaccggctcttttaattctaaggcaatggtaaggcaacttgaagcaaaggaggcaaggaccgaatcaattttttcaactcgcccaagaaagagattttcagaaaaatagagacttatctcatctgaaaaggtatacccgaacaccggggcaaagccggcatcaatgagcaatcctttggtaacaaaggccatggcatcggaaaacttctcatcaaagggttcagaaaaatttagtttatctgtaacctggtgaaatgcccggccatcaagacggacgattatcggagagagggtccgtaggtctgcatagatttccctctctttcataagtcagggttagagttccccttcgtttctgaacatgtgcgggatgtgcctgataacaatcacatcagatatactcttgaccaaccggtacgggattttcacccctttatgagacttgatctccatgacttcagggttcagttttcctacagcaagtgcatcaattctctttgaatcaatatccaggataatatcatcaacctctccgatgaacatcccgttttcagaatatatttttagtccgatcaggtcagtaatctgattcttcatactgcattgacattaataccggatagataaaaaatgttaccttatcatttcaggattcgatgaaaaatcaatcgtgggatacgatcatctgatgaaacaagtatccaaacatatattatgttcatacaggaatattcccgtatggtgcacatggctggttatacaatcttgaccatattggttctgtgtcttgctatttctgtatttcccgctctggcagagaatactcctttgggatcatacatcgttactgagatcagggatgaagccggggcccttatcaaacattcagatctgtcaagaattactgcgacaattgatggtttgaatatatccggtagcgcaggttgtaatcagtacaaggcgacgattgctatgaaagacggggccattaccatctctgcccctgcagcaactctcaagtactgtcaacctgaagtaatgaaggaagagtcacagtatctgaaaaaccttgaaaagattgtccattacaagattattgatgataatcttctcttgtttgacgcggaaaatcaccccgtcatctcatttaccaggtatgaggagaaggaatctgtaccattcccctatgacactccgtttatacttaccagaatcttcagggacgatcagttaaagtatgcttttcttgccctgaaaaccctgattgaatttcatccggacgggacctttaccggtaatgggggatgtaacgaattctcaggaacgtacaacctgactgcgaacaccatcacctttaatccggtgaccattacaaagaaggcatgtaataagagcagactaaaccaggagcaatccctgttggatattatgaagggaacgcttagatatgagataaggaatgatcaggttatcctgatgaatgatgccggggtagtggttgctgagtggaaagagtacgatactccataaaaattctctcattttttgtatcattctgataatttttcgatagctatactggttccgagtgccaaacatatcagataatatggatggctcatttaaaatcggccggctatttggtattccagtcctgattcattttacctttcttcttattataccgttatttgcctgggtaatcgggtcagatattgaattcacggtagaaatggtcagaaatgtctttcatgtgagtattgatgaccggtatattctatccggatttattccctattttcttggagccaccgttgcaattggactctttattggggtgtttatccatgagctggcccattcactcatcgctctccgctccgggattcggatagacagtatcactcttctgttctttggtggagtagcagcaatagaagagcaggagcctgatccaggaaccgaacttgtcatggccctggcaggaccgctcacaagtcttgctatcggtcttatctccggggttcttgtttacgttgttcatcggtttgttgattcatcagcagaggccggagttcttatctatatattcgggtatcttgcgattctgaacatcctgctctttgcgtttaatctcctccctgcctttcccatggatggcggaagggttctccgtgcctatcttgcaacccggatgccccttcataaggccacctccatagcatcatcggtcgggaagggatttgcagtattattcggtctagtcggattgatcctcttctcccccatcctcatcctaattgctttcttcatatatatcggggccggacaggaatcaatggtgaccagatacaacttccttttaaaggatgttacggtcgggcagatcatgtctcgtccggttgtggaagtaccgccgcggatgccgctatctgaagtactgtccttgatgtaccagacaaagcatctgggatttccggtcacagagctcggccatctggttggcatcatcaccctgactgatcttgcacggacaccggtgcttgaccgggatgccatgcaggttcgtgatgttatgtccagggatgtagttgtcctcccgcctcatgcaccggttatggacgctctccggatcatgacccggcaggatatcgggaggattcctgttatggcagaagagaagattatcgggattgttacaaagtcagatatctttacggtaattgagctgcgggaagtgtaagatccagaataccatccggcagagaagtaccggtgaattttgcaaactccttctctgatctgaacggtcgttttgcaatcacctgaactattccttttttcgagaggcccgggatccatctgagtgctttgtggggaagcgtgttgattggaaccggacagggaagagccgtcagggaacgcatgccatggtcaacgactaccacatcaagaactgctcggactggcaggggaagaggaatgccaacaaggattgggtatgatcccatctgccttccaaaagagatatctccctcttcttcaatgataaccgacctgaggatggtgaatggagggaagacctttcgaagcatgggaagatcaaaattcttccgtgtccaatctttaaatgaatgaaaagccttgtccggaactggaagagcattatgcttacttgcttttgtcccctcacatggcatgagctgacggatgttcactctccggataagatatcccttctgcaacacgttttcaagaaattccctgttcagtgtataggtattcaggctttctcccgcaagacctgcaataaagttcaggccaggtaagagttcaggaattccatctcttctcaaactccccacctcatgcacaatccggatagcttccatcaccatatcaggagtcgccttgagattgttctcctcgatgacaaccggatctgcagtctccatgccaaatgctgcaatgtctcccggggtatgatgtctgatgatcgcagacaggctttcacctgcttcttccgggtgtcgtgctattgtgcccggattgacgttgtcgatgtgaagggttttcagggaaggagcagacgttctgactgatgaaaaaagttcttctatcaggtctggttttgggaccggaaattctccttttcctgcctgccaggtcaggatatccggttgccggcctattctgaaatgagctgccccggcctgtgcaagggcagaaacctcgttttttattccctgaagagatcgatactgtggttttccatagagtggttcagtgcaaaagctgcatccaccggtaacttccctgctgcatccccgtgcggtctcaatctcacacatcacatagggataatttggatgctggcagataatgctggcacctagttctgaccagggatcttctttctcatatgagaagagagcagacgggatattccctgaaaaccatttgtcaagtgcaccggccggcgaaccatgcagaagagtatcaacatggaaatctcccttcctgagtgcagcctgacctccggctgatcctgctccgaagagaatgggaccgccaagaaaggtatgcgggttagaaagggctgatccaatctgctctatctcctgccaggtcgccggtgtgcccccgagatatttccccggaacggtcatcccggcgatcatgacgacatacgatgcagtatttgccgcacaaagcaggccggggtcagatctgatctgatcaatggtatgataggtgaccgggaatccatgagagaaaaatacccctgcgatggttcgtatatagggggagatgtaaggaggaacgccaaggcatgccggttcgtcgacatacccgtctattatccatgcctcagagctcatgtccacagagggagaggagttttcttgcccattggagttttcctttcttcataggagtgaccaccggatcatctagatcaaatccgataagggttacgtctgatgcctgcatctcatgagcaaggtatacggcccgatcaccatcggtaaatccaccaaagttgtagacatggccaaagggttttccctgggtggtcaaaaccagcggtcctttcatccggggaacccatgtccgaagacggggaatattatctccatgggcatggactaccagaatagtccctttcctgttcaaggtaactgcctcatcctcaatcccgtcaaggtcggtgacgatgacatcaggtgtaattccatgtcgtatcagaacgccggaggctgcatctgcagcgatgattactccggtaattgcttccagctcctgtgaaagagttggtgcattcccgcagattgtaaccggttttcctgcaatacaggattttaaaagatctgttgcatcctgtattgtcagatctgcaagaatatgtgcagcccggtcatcttctgcagggtcaaaagagaagtactcgcaaatctcctggtacaccggttcccagtcttcatacttcactctcctcatcctccagaagaccgacgaggcggtaaaagttctgtaaaacgggatctattaccaggtgtaaaagttcttccttttccctgacatgagcaaagacatggagtggaatacttgcagcagccatggtggcatgacctcccgcatcaccgacttctgagaacgcttcgctcatgacattgcctaggttcagtctgagatcccggttccggcctgacatgatgatcgcttcatcagtaattccatagacgagcgcggtactgattccttccaggttgatgaggagatccgcggcctggggaagagcatcacggtttctgacatacccgacatttgaaaacaggtacccgttccttgtttttctgttccggattgctgccccgataatatccatggtctcatgggagtactgaggggacatgatcttttccagaagatcagcgtcactgaactccaggaggaaggctgcatattcaagatcactgggtgagacatttcgtctaaactgttttgtgtcagccctgatgccgtagaggagtgccgttgcaaccttttcgtctggttcaatattgagttccttgatatattcggtcagaatggtcgcacaggcacccacattctgcctgatatcgataaaatggaccttttcaatgtgagagatatcttcctggtgatggtcaatgatgatatcaaccggcatggagtgaataagaccattatttgctccaggtcccttgctatccactagagcgatatgggtgcattcattaagtgtctctggttttaatttctccatcctgatatcaagcagatttaccagtgtccggttctcctggtggccgatgatcccatcatagatgattctggtttccagattctggtttgcccgttttgcgatcgctgcaagagccatggcactggcgatcgcatcaggatcagggttggtatgcgtcacaataccaaagatgccagaccaggatgcaagcaggttatagagatcacgggagaggtggtgcttttcaagacggtgtaagtgttctatagcggcccgtgcaactacatgctgggggtagagaacgaggtccgcgccctcctgcatcaggagtttttcattgattggatcctgcgcacgggcgacgatatgaacccgtggatatttttttctgactgttttcagaccggtaatatttgcttcatgattatcgctgaccacaaaggcgatatcaaaatgatctattccctgcagcatgtcaggatcggtaagatcgcgaagaaaagcttcaatcttctgctcccgaagttcctgaacacgttcaggattgctatccatacagagcagtctgccaccttcctttttcagttcttcaaggatcaggtatccaacactcccacacccacaaatgagataggttctgatccccggtgacgctgccgggctgaatccaggcatattcaggtataggttggattatagaggtataaaggggcgtaagaaaactatataagtgggctaaactaacatgttatggcacaacgggtctgtagcttagtcggtagagcggcggactcttaatccgcaggccaggggttcgagtcccttcaggcccgctcgttgtttcttttttgcaatggtctcaatcgattatttaacgttctcattcataaaattctctgatgactggtgaagaaccagaatacgtggaagtaacctgccagcactgtgaaggagccggatgttgtttttgtaacacaaagggaatggttacggtgaaatggcctgaaaagatgtgtcgccattgtaacggagtcggatgcatatactgcggatatactggctggggtggtctgaaagggaaatatgattaattttagtgtggattattgatcattctcttgggtgactgttgatattggggggatatgaagtctattttcagaccgaatccggaacggatgagacttaaagggaatttaaaaggccttctccggttactggacgggaaaaatgatactgcattacggatagaagcaatattagcgctcggccggatgaaaactccggttgcagttgaagaacttatcagactttttcaggaccctgagtatgggatcaggaatgctgcatctcatgcgcttgttcaaattggatctgatgctataaacccgctgattcgggctttgtctgtatctgatgaagagaccgcgaggatgattcataccactcttaccgcgatgggtgatgatgcagccagggaaatagtaaagaatatcaccacacttcagggtattggatatgaacgagcaggatatatcctgaattcaatgggtactcggattattccggttcttatagatgcctacgggacagaggatcagacgacgaccaggttcatcgagggtctgtttgagtcatttggcagatcagcaatccagccgttaatcaaggggctgaatcatgaccatgaagaagtcagagcacgtatctctgcttatcttattattctgggtgaccaggtagttggagatctcctctcatcatgcggtcaggatgaggaatggctgcgagaactgaaattttacatcatcagtgagataggaaagccggcactcgaccccctttatcaggcactcaaagatccaaatccggtcacttcttcaatggcacaaaaggcattccttgagtttggagaatcggcaattatgcctctgatatccggtctgtatgatcaggaccctgaagtccggaaggtatcagaaaatgccctgaccaggataggagagcctgtcatccctcacctgcttgaggagatgtctgtacgccgtgatactgatcgcgaaccgattatctctgtcattcagcatatcggtgaacctgctatcccttaccttatcgggaatctgattcattcgaagggtgatcgttcaaaacagatggttcagattctgtcacgaatgggagctgtcaccattccctatcttatcaattctgtcagggagcaatcagatacgtccggaataaaagaggcaattctctcgatggggcgtattgcattcccctttttggaagaggcatctgagcgtgagcggggaaaaacttctgtattcgctattgatcttctcagacagattgatccggtcagatccattgagccgatgattagtgctctgtatcatactgaccgggaggtacgggagactgctcttgataacctggttgcttcaggtgagattgcgatcccccgtctgattcaggttcttggttctggcgatgaagaggcggtcgatctggcaaagattgctctcatgaagaatggagaactggcaatcccccatcttgtagattcgttgtcagatcccatgggtgccaatcatgctcttatcctggagattctccgtgagaacgagactgctgctcttccgtaccttatcccgttcatggcaccgggaaaggacggttatgatgaggcgatgacacttattcgtgagattggtgcagatgcaaccgctcctcttctgcaggctctttcaggttcagggcccgaactggccagggagatcacgtcttacctgtcagagttattcagtcaggatcccaggaaatttatcatgcggctcttttccggtcaggtaccggacaccgatctgatgtacgaactggtgcatacctcacctgaggttgtcattccggagcttatcgatatatttcagggagatgacgggtcccgggcacttattgcaggagatctgttgtccaggtttggaaaggatgctattccaccgtttattgatgccctccggagtgaaactgatgatgaccggaagcttgagataacgagtttcctgattcgaatcggagaagatgccattcctgatctggtagcacggcttggtgacgaggatattgctccttatgccatggcagcattaagcgctattggcgaacctgcagtacccgctcttttgcctttgctgaaaagtcctgacctgattgcacaacaatatgcgattcatgctcttaccagaattggtactccggctgcttcggcactgatgaccctgatgcaggaagatgagagtcttgtgccattgattagccggataatggccggaatgggaggttcagccctgccagagcttattcaggaacttgagacgcttcaaggatcaggacaggagggtagcagcagaggtattgcggtcatgtcgctgataaccgagatagctctttcaaacagagacgacctcaggcacctcttctccatacaaaatccgatcctcatcacgatgtttgagcgtatatttatcagtaagggtgagcagatcctggcccctcttctggatgccgtcatgtatgaacaggctgtacctgacatggccgccaatatcatcacctccatgcgcccacaggcacagaccgccgttaccaggcttttaaaatccataggtcctggagacagacgacggattgcccttttaaaggtgcttggtgttctgaaagatccggcatctgcccctcttatgtatgaggcattgcaggatccggatcatgaaatcaggatgactgccatcagggaacttggaaagtttggcagggaagctctgggaccactgaccgatgcgatgcatgacccggaccctcatgttcgtgcagcagcggttgaatcattgggtgatatcggacttcctgtccttgatcagctgattgcagcattaaaagatcccgacggttcaatccgtgcagcagcactcaaagggatatccaagatcggggaaccaggtcagtttatgctggttcagacacttgatgacaaagacagaaaagtcagaaatgcggtggcaaggttattggaagagagcgggtggaaacccaagtatacgactgatcggctgagttacctctttgccaaagagaaatttgatgatctcatccgtatcggacctccaagtgttgatacccttgccaaggggcttcatgatgatgaccctgaaatcagggaacgatcccgggatgcactcgctgtcataagggattctattcaaacataataacaaaacatactagcagaatggaaatccactagtaggtaccggaggagaacgcatacgtccatgaatcacatcatctccatccatgatctggaccgggatcagatcgaccggctattggccagggctggagaagtaaccgctgaatttgcaggtaaagaaccgcttaaaggaaaaatcctcggtctcctcttttttgaacccagcacccggacacggatgtcatttgaatctgccatgctccggcttggcgggtcctgtatgaaccttggcggcgtggaggtaagttccatggcaaaaggagagacccttgccgacaccatccgggttgtcagcgggtatgctgatgccattgtgctccgtcatcccaaggttggggcagccaggcttgccagtgaattttcagagattccaattctgaatggaggggacggcgccggacaacatccttcccagaccctcatcgatctctataccatccgtcagtcaatgtcactagacaacattcatatcggtcttatcggggacttgatgtatggcaggaccactcattcccttgcctatgcactaacccactacaatgcgaggatccatacgattgcaccaaagggactagggcttcctgattccattcatgataatcttgaggagcggggggccaccgttatcgaacatgattcgattgaagaggtaatcagtgacctggatgtgctgtatgtgaccagacttcagcgtgagaggttccctgaccctgccaaattttatgatgtatcgtccagttaccggatcaccccctcccttctcactgatgtaaaggaacaccttgctattctgcatcccttaccgcgggttgatgagattgatccgtctgttgacaaccttccctatgcccggtattttgaacaggcaagaaatggcgtcccagtcaggatggccatgctcaccgaggttatggtatgaccaatgaagagccaaaacggactttggtcatcagcacaatcgagaacggtacggttatcgatcatatcaaagccggagaggcactcaccgtcctccggattcttgggataacgggaagtacccgggagtgcgtcagtgttgcaaccaatgtcagcagcaaggcacaggagaagaaagatgtagtaaagatagagaagcgggagctcaaagcacaggaagttgatcggatagcccttgttgcaccgaacgccaccatcaatatcatccgtaatttcagggttattgaaaagaaaggtgttattatccccccggttctgattggagttttacgatgtcccaatccctgttgtattacaaataccaatgaacctgttatgagcagatttgagatgcatgggaagaaagcagtttgttcctattgtgatgcggttatctcatccgacatctcttcgcatatcatctgaactcccttctttttggggctgctgctgtatcagtctcccatgtgtatcgatctcaccccgccagatacgggtacttgatatccatcggccatcctctgcaaggacgcaccgtatcatgtgaatttcaacgcacggctttccccgctcccgcctcttctgattgatatttttcccgacaggaaatgtctcttcactgacaaccagagcatcaaagtctgcatcaagtgtggaaccgtactgatcatgcagttcttctatctcccaggtcgtttcaggttcaagggatttgataaatgagaccagatcccggtaccggtcagcataggaatgaatcggatgactcttccggttggcaaaagaatcactggtaaggccgattatgaccgtcccttccggggtggccaggtcaaaagcgcgtctgatgagaagccggtgtccgtcatgcagaggatcaaacgtgccccccaccataattttcatagatatactgtttcatgcgattttataaaatctgatatcattcgttctctgtgaggcctgaatatctgacaaggtattccggtactggaatcatatgatgagggaaaaggtggaacaaaaggctgattattactgatgctattatactatcggagtctaaacgtatgagataaccttcccgaacagagggttggtgaatgcggtaataaacctgagaacgtcttatgcagatttatcagaatatcccaaacgctgcttttattgcaccaaactccacggtcattggcgatgtggttaccggtcaggaggtcaatgtctggtacggagctgtcatccgtgcagacaaggaccggattaccattggagatcgatccaatattcaggataattgtgtggtccacacttcaaaagggcatccggttaccattggtgacgatgtatccgtcggccatggcgcaatccttcatggatgtactatcgggagcactgtcctggttggaatgggggcgattgtattaaacggtgcggttgttagtgacaataccatcattggtgcaggcgccgttattactgaaggaaaggtcatacctcccggatctctggtccttggtctgcctggaaaggtgatcagaacactttcagatgaagagatagcaggaatacgaacgaatgcttctgagtatgtaaaacttgcacggattcatgcccatgaataacgcggtcgtaatcggaggaggcatagcaggaattactgctgcactggatattgccaaccatggtgtacatgtagcccttattgaacgtgaaccgaccatcggaggtcatatggcgatgctggataagacgttcccgacaaatgactgttccatgtgtattttaagtcccaagatggtcgaggttgagaggcatcccaccataacacttcatacctgttctgaagttatcggagtagagggagaagcgggaaacttctctgtccatgtgctccgtcatccccggtatgtcagggcagcggattgtaccggctgtggggactgtgtggaagtttgtcctgttgaggtctataaccggtttgatgccgggattggtgtcaggaaagcaatatataaggcgcatccacaggttgtacccaatgtcgtcatacgtgacaaggagcattgtattgactgcggtctctgctatgatatctgtgggaaacaggccgttctcagggatagtgaagatgcagaggaggagttagtcatcaaggccggaaccatcgtaatcgcaaccggatatgccgtctttgatgcacgaaagaaaactccctacaaatatctctcaataccggatgtaatcaccagcctggaactggaacgtattattaatgccagcgggccgacaggggggaaggtaaaacggatttccgatggtcagccgccaaaggagatcgtctttatccaatgcgttggttcacgggacttgccactgggatgcccctcctgttcggcagtctgctgtatgtatgcgataaaaaatgccatgctgattaaggagaagaatccggatacccgtgttacgattctgtatatggatatccgtgcatatggcaagggatatgaggagtattatgcccgtgcagagcagcttggtgtcaggtttatcagggggatgccaggagatatctatgctcaggacggaacgatcatcgtgcaggttgaaaattcagagacaaaggatgttcttaagatacatgctgatctcgttgttttgtctgttggaatcagaccgacaggaaatgcatcaacacttgccgaacgtcttggtatcacctgcgatgaatcaggattttttgagagtgtaaatgtaaaatcaggtccggtacagaccttaaaaccaggagtttttattgccgggacctgcaaggaaccaatggatattcctgattctgtcatggaaggcggtgcagcagcaatgcaggccgtaatgagtctgatgcgtggatgaccatggagcctcttcgtccaattctttttcacccccacattccctcaattgaatacatagaacagaccctgcttcctgacatctatgaagtcagaaccgccaggacaattcctgatcttgctgaagcgataaaacgtctgggtatcaggggtgcaccagcgttagggtgtgccggaggatgtggggttgcgttatcggcgctgattacgaaagcagattcactgccggaatttttagaccaggtgggatcagatgcagatcttctcagaaaaacccggcctactgcggtgaatctcttttatggcatagatcatgtcctcactgctatcatgtcctcacaaacgatagaagaggccaaaagcagggcagtagatgccgcagaggaggttatcgatgctgacaggagaacctgccatgccattgggaaaaccgggcttgaagtcattccggatggtgccagaatcctgacccattgtaatgcaggagctcttgcctgtgccgaatgggggactgctcttggagtaatccgttccgctcatgaagcaggaaagaacatttcggtatacgcctgtgaaacgcggccacttctccagggtgcccgccttaccacctgggaactgctcagagacgggatcgacgtcaccctcatcacagattccatggccgccgttctcatgcggaaaggtgccatcgacgttgtaattgttggagccgacagaatcgtatctgatgcagtattcaataaaatcgggacatatatgcatgccgtctgtgcacagactcatactattcccttttatgttgcagccccactctccacctttgacgaggagagctgtgaagatatggtcatcattgaggagagggatccacaagaggtcaggaaggtccgtggatgtgtgaccggaccagataacgtcccggtatggaatcctgcttttgatgcaacacccgtacatcttatctccggaattattaccgagtacggaatttttacactccctcgtgatattgaaaccataaaacagttaaagaaggggaaggatatgcagaggcactaaggtgatgaccatgcttcagccatatatgccggtaatcacgcttatcggagagctgacaatactggtaattttatccatccttgtgcttggatgcattctgcttattcttaccctctatgccatccgctcaggaaatattctgtttcctaagttcatgcgggcaggacttctctttcttgaaggaatgatgcgaagtatgttccgcctcttcggttttgaagacagtgattttttcaggatcattgtaacgcttcagaatacgctgaaccgaaaggcattcatgtctatccccgtgaccgaacgggttgtctttatgcctcattgtcttcgatccaatgcatgtcctgctcacctgcatgacgaagggctgaaatgtcgtgaatgcggtctctgtaaggtaggagagggaaaacgtctgttagagctgttaggataccgggtgtttattattcctggttcttcttttatcaagcggatgataaagcggtatcgtccccgtgcgattatcggtataggatgtcttcttgaagtaaaagaggggattgagatgtccggtcagtataacatcattgccatgggagttgtaaatacctctgatgggtgtgtggagacttctgcagactgggaccaggttttcaagaccgctattcttggtattgcaccggataaaatccccgaagagctgaaaaaatatattgaatgagattacagcagaactgccgagagtaggaataccaggagtgaagcaaacattcctgcctttaatatctttgaactctttgcttttatcatctcttctgaattggttgccttcattccccgtattgctccaaacaggatgattgcatcaacaagaatgatggcacccaggtagaatgccccccacctcgaatagaggagcagagacatgagaacgccggcagttgcacttatgagagcaagatagatggttgcacgaataccatagaggagaggaaatgtccgtgctccatgttcattatcccccggcatgtcttcagcgtcttttatgagttcacgtgcaagcatgacaccccaggtggcaccggcaataggaaaaacagatataatgccttgagttccttgtattgcgccaccgaacagaaagatgcttgctgcaagatatgataccgatatatttccaatgagaggcgtcttttttaaaaatgatgcatacagccataaaataactgaatttcccatggctattccggcaagaggcaggggggtgaagaggatggcgataccattaccgataagaaagagaagaatggcatacatgagtgcatgccctggtattatctgccctgatgggatgggccggtcaggttggtttatcgcatcgatctccttgtcatagtagtcattgatgacattgcctgccccagtgattgtaaggacgatacaaaaaatccaaaaaaactctgccggaatagagccggttgcgataattgatgcaagaattcctgctagtccggcaacaactgcattaaccggccggatgatggagagataggctgcgccgttcatttcacacctgtttcaaaaaagggtacggacgtggagggatttgaacccccggcattcagcttaggaggctgacgccatatcctgactaggccacacgtcctgccttattacatgtagcagggataggtataagattatcgaacaccatttttagcggaatggacctcacctgggtcacggaaggcaggaccacgattgcagtgccctgccagaatcctgacgttccctttccgcctggcacagcgcccgtattttataattccaggatggcactgaatcgtgacagtaccgttcttgtggtacggcagacccatccacattcatatctggatgcgatggccgcctccggaatcagggggtgcagggtcggttatgaaaccggtgttccggtcaccttcaatgatcgggatcagttggcgattgatcttatcacgcataatgtccagtctcttgggataaaggcagatattacctgtcgtgatgcgaacagtctgatgtcagatgagaagttcgggtttgtggatcttgatccttttggcactcctgctccgtttattgatgctgccattcgttcttcggggaagtatcttggcgttactgcaactgatacggcaccattatgtggtgctcacctgaaagcagggatacggcggtacatggcacggccactcaataccgaataccataccgaagttggccttcggatacttcttgggaatgttgccaggcatgcagcggtatatgacaaagggattactccactcttctgttatgcccatgaacattttgtcaggcttcatctccagctgaagagtagtgcgtcggcagctgacaagagtattgcacggcttggatacattcatcagtgtccgaaatgcccataccgtttggaggaacagaaattcttccccgggattcatacctgtccgctctgcggagcatcattaactccaaccggaccactctggaccggatcaacccatgatcccaatattcttgccgggatgatagaggatgctgagacctttatcgccggtgatccatcaggactattaaaactgttagcattgtgcagagatgagccagatatctcctttagttatgattatcataaactggggaaattttaccggttgtcaccagggccgatcgatgtgctgctgaaccgactcagggataaaggataccgtgcaggccgggtgcattattccgggtatggtatcaagaccgatgcaccgctcgaagagataagggattgtataagttcgtgaagaataagggagaaaaaattaccagggttttgggatgaatgtatctgcatttattatattgacacaatcttctgttgccctgatgacaaagagacctttcttctctatgctgctccggtatcctctgtcaggaatgcaactgccccgtatacccttttatcagaatattccggcatccatatctttgtcatcttcagttttttttgaaatccctgaaatcttcaggccgtaaggttgtttttactttgacaatcacgatatcaatgccgtttattgcattaatgtcaaattcataatcaataccctcccgttccccggatctccctttttatgatatccgtaactgccattccccgttggttcaggatgggtataatgtctcgatccaccagggtttcaattaattttccccactatgatgtaaacaatctttccagtttattgaatcttttacctgtcttctgaaacatcagtcatagtttatcaaaagtgagcggaccctcagtattatcagagtctgatgtcgggggagtatttgtctttgttgaaggtggcatctccacagtgatatccatgtgatatcatctaaaaaaaataattatcgttcgatgatgatctgcagaatatcctcatctgcaaggttatgggcaatacctacccgctgtgcttcatgtttgacagatgtgccccagacacgtgcatatctgaatttatcaacaaagtcacgatgcaatttccgacagacgtcttcaatttttgaaccggttctcatgatgagtggttcatccatatctgcaggtcctgcctggggcttgaggaatatcctgataaatccaagtgcattgtatattgcatcctttaattcttccatgtggtagccggttgctgcagatatcatgattggtttttgtccaaaccgctcggtaagatcttcttcgatcttcttccggtccttttcatcgataaggtcaaccttattgacagcgatgatcgccgggatgtatactctgctccccatgattgcatcaatcaggtcatcctgggtagcatttcctctgataagaatatctgcacttgcgatacggttctcagtcaaaatggaccggacttcttcgatatccagatccaaggttccaaccgcatttaatctgacccctccccgtgaggtcttttttatagtaatatcaggttttggaacattgaccctgatacctgcgtcgtataattcacggaacaggacgtccacgtgtttttcattaaaaacatcgacaagaaggacgatcatatctgcatttctgacaacggcaatgacttccttcccccggccttttcccatcgcggcaccggcgataagtccggggatatcaaggagctgaatttttgcgcctttatgttcaagagcgccgggaaccactgtcagggtggtgaatgcatacgctccggtttcactttgagtacctgtgagcacattcaggagcgtggatttaccagtagaaggaaaaccgacaagaaccaccgttgcatcgccggattttttaacggcatagccttctccaccgccaccggctttcatcgcccggtttacggcttcctctttcattttggcgagttttgctttgagccgcccgatatgctttgaggtagccttgttataaacggtattctggatctcgtcctctatctccttgatttgatcctcaataccagccatgtatcctaatacgttcccctcttgtactcttatatctgtgggatcatttcaggaaaaaccggtttgtttatatatttcaaatgataacatttagaggcacagctgatatagtgtaggggtcaatcatgcaggactctcactcctgcgactggggttcaaatccccatatcagcataatttatcttaaatatttgaggctgttgcacaaacacaaaaaaagcttaatataaattattaaagcttaattatatatattattaagatcaatatattatatgtctcatcgctataacatgattagaggatatggtaatgaacaacaatttttactccctgtcaatgcgatggactggctatctgaaaatgatattacttatggcatattagaaattctttcgattctcgatattagtccatttattaataaatatcgtgacgatggtcgcggttctgccttttttgatcctcgttcaatgcttggaataataatttattcaatgattcgtggagaaaaatctagcagaaaaattgagatgtgctgccattatgatattggatatcggattgtcgccaataatcttacacctgaccatacaacgatctatcgtttcaagaagaataattcaaaagaaatcaaatccctttttaaacaattatctcaaattatcgtagaatccgggatagcaagaatcggtgtcctagccctcgatggatcaaaatttggctgtaatgcctctttatcagccaataaaaaattaaaataccttgaagcagagctaggtcggctttttgatgaatcacaggaaattgatgagttagaaaacgatgatataaatattcaggatatggagattaaccgactacctgagcatctttcaacaaaagaaaaacgaaaggaagttcttaatcgggctaaagagaaattaattgaacgacatgatatcgaatctaaaaaacaagaagaaaagattctggaccgcgaaaaagaagaattagaatcgggtaaaaagaaacgaggtagaaagcctttagagcctaaaaaagagccatcttcagattcaaaagtaaatctcactgatcctgaaagtcagataatgtcaaccaccaatggctggattcaagggtataatgggcagattatcgtttctgaaaatcaatttatcctcgctgcaatgatatcagatgagcaaaacgataaaaaattattaatacctatgctaaatgaactcgaagacctttttacgggtattcatccatcaatttcgcctaatatactactatctgatgcaggttatttctcatacccgaattctttagcagaattggattatggcattcaactcatcatccctccttctaaagaaagaaaaattccagaatattcagataatgatgggtatatctcacgaatggaaatgatatgtcgggcgatttgtatgggagaaataatcacatttccggaattgcaaagtatcgggacgtttgtttggcaatcttttatgaacagagagaaacaagcaacaactcaggaaatttgtaaacgagttatggaagtacgtgtgaaatcccccactggtagagagttatatcgaaaacgaaaatacatggtcgaaccagtttttggtaatatgaaacataatatgaggtttaggagtttctctcaaaaagggaaagagaattgcgagggagaattctttttagctgcattagtgcataatataaaaaaacttatcagatttgagggtatagttaaaattaaagaatttgctacgaatattataaaaccgtcaagaggttcaggtttttcctatatttttgcaaacacagtatgtaaagtgggaattgatacatgcaggttcatacatccattagtctattttggttgatagcttaaggggtagagatcgatcatttgtgatcctgcatgatattgatcattggtgcaacaccctcatttgataattttaatttctctgttgtaatacctttttccagattgatacatcattgccgaccatagaaatattgcagtcctggaatcattcacttggaattctgaagaagaatatatcataaagaaatccatacgaaaccttgattcaccgtttatggatttggctgatgatgccaggtaaaaaaatttaaaaaaaattacaattcagacgatcaacccaagggggaggtctgtagcactctacaaagaaactctcactgagtagagcatcgataaattctcgttattcacgtgtaatcttgcacattatgacaatgaaataccgcagaacctatttgttggccttcccggaggcccggctcccgctgaccggtctgtcagattaacaaaactcaaccagttcaatctcccgataaaatccggtaatgatacaatccacaattatgtcatgtaggtatttcacctgttaaactcggttgatgttgtcaccggagaagatccagcagccattctagagagtggagcagagagcaatgtgaccttcttccatgaagtgcaattatttacacagttttctctggtgagggatcataagaaccggatatactaggtaaaaaccgacacgaaccagaacattggaaagatcgatctgaagaaactcgattttatttcaggatcctatcaaaaaatttccaataaatgcccatatccagaagaaccgtatgattttacccggagttttactagatgaaggagcgacagaccgatatacattattcgtaaatgcatgtatcagaagagtggtatttctattcgttctgatgagcgactataaattcgtaacttgaataggtggatcggatggatccgcctgccttccatggtatgtgaacctccctcatcaccatggttgcccagcccggcttgaatcatcagtcgcgatagtgtaggaatccggcagaagaactcgttctctttctctgtgatctgattcggtaacaggtgctgacgaggaggatatcgtatacatattcgtctgaaatggtggttgctgtcagagattactggcggcctgatttagcctgatatcctgataacaataatcatcagggaccggatacaaatgaattgtattcaaatagttcttcccagatagtataaccaagaagtagtatggctgatacatcagataaccagacaccgggaaccaataaaataccctggaaatgcaccgtttgtgggtttctgttcaccggagagaaacccccgaaaggctgccctcattgtcatagtccgagtggtgagttcataccggtgcatgacaagccggttacctgtccggttgaggattttgacgtcctcatcatcaatggaagttctcaccgagctgggaataccggggtaatggccgatattgcggaagaggtcctgaaggaacgaaatatctcataccggcggtttaacctgaatgaatatactatcgataattgctggtgctgctatgcggtcagggcccagtcatgtgactacccctgtcggaataatgatgatgacatgcatgtatttcatgagttgctggccaagacaaaagcggtgataattgcttcacctattaactggaacaacatgtctgccaggctgaagacattcctggaccggacaacctgtatgcagaacctctatcatctgcaaaaaccgggtctgacacaggggaaagtagtcgggattctggtctgtggtcatgaggacggagggattaccactgccatgaatatctttctgaactttcagcagctcgggtatattctggctccctttgggattgcataccgaacccacggggcagaatactccagcaatgaggatagggagtttttcagtaccgatgagatgcttcggacccataccaggggtgttgtcaataatgtgatagagatgattgatctgaatattgaaagtcagataaaagataggataattccggtttcggaatgatttttctaaattgaattccttttttaataatttttgaatatttttcccggacaaaacaatattatcatatcaccggtaattcacatatcatggctgtatggaaatgtaacatctgtggatatctctataatgaaacaaccggagatccgacctcctccataccacctggaactccatttgcagcaatccctgatacctggcgatgtccgatctgtcatgcagacaaaacagtctttatacaggtgagtgaagcatcaccagaaggcaccccattccccacagtttctgaagcaataattgaaaacctcgttcactttggtatcacagagtatttcggagttcctggaacgagcagtcttgggatcattgatgcaatcaggaaacatgaacgagcgaatttcacgctcttccgacatgaagagaatgcagcaatggccgcttcagcctacaataagctcaccggaaaagtagcagcatgtgtgaccattgcaggaccaggagcgaccaatcttgcaaccggtctttatgatgccaaggaagatcgggcatccgtgctctcgataaacggacaggtagagatgcagtatgccggtccgggcggttttcaggagattgatcaggatgcctttttcaggccggttacggtctataacaacactatctatgataaaaagatggctgtaaagatcctgaccgtggccgttcagcatgccattgtcagaagtggcgttgcacaaatttcggtaccgaatgatatccagaaacaggagattgctcctgaacataccgagatcaggggagtcataccttcacttatcgtcagaccggatgccctgaccatacaaaaagccattgaactcatcgcttcatccaaaaatccagttattctcgccggatggggtgcatgcccctattctgatctggttgcctccttcgcggagaggattgacgctccggttctctcgaccttccgtgcaaaagggatatttccggatgaccatccgatgtatgcagggatcctcggaacagtcggctcgtccggagcacggactatggttgagaaggcagatctgctcataaccctgggtgtcgggttttcaaaaatgacccgggtgcctgagcatatcaggattcttcagatagattatgatcctcttcgtcttgggaaaggaaaggataccctgccggtgtatggggatgtcggggaggtcatattagaacttttgtcgaaactccctacatcttcccatacccatgcacaagaaaaggtcagtgctgtgaaaaaaccctgggaagaagtcaggagaaaagaggctgaagatctctctgttcccattagacctccttttattatggatgttctctccagagtaatcccgccggatgcaataatctccatagatgtcggggagaatggatggtggtttggcagaaatttcagaacacgtggtcagaaatttgtcatgtccggctatcttgctaccatgggatttggatttcccggagctatcgccggaaaaattgcataccctgaaaaacctgtcttttgcattaccggtgatggggggtttgccatggccatgggagattttgtcactgcagtaaaaaacaacctcccgatggttgtgatagttctcaacaatcatgaactcggaatgattcgagtcgagcagcagctggagcagtatcccaattttgcaacgagtctccataatccggatttcgtgatgtatgccagatcctgtggcggtgatggtatcagagttgaacaaccggacgtgcttgaaccagcagtgaaatgggcaatgaatcagcaatgtccggttattgttgatgtgataactgatccccggcggtttccgtgaaaaatgaatctaggaatgtagtaatatttttggcattcgaaaacagaggatatttgttcaatggactcttacatattcggccatagtatgggtatattatgacattcgctccggaaatcaatcagacatcgactcattccgggaccggttccactctggaattaacagaggataaaattctaaaaacattcgagagaattcatatcctggttgatactcgttcaatcatcttctctgctcatgcacggaccaggatgttcgaacgtggcatttcatcagaggatatattacctatcctgtcaaaaggagagatcattgaaacttatgatgacgatactccatgtccctcctttctgatgcttggatatattcacgattctgtgctacacattgttattgcagtttgtgaagatcacataaaaatcgttacagtatatcatccggataatcgatggataaacgataaaatgaggagataaataatgaaaccgggattgtgccagttttgtaaaggaacaatgaaagaaggaaaaacggaatttattgcccatgtcagggatcaggtaattgtgataaaagatattccagcctttgtatgcgaacgatgtggggaggcgtggttttcatatgagacctcagaaaaaatcgataaagttatgcaggatgttcatgccggaacaatctgtgtccgtccgcttgctgcaggtgagatcgaattaccagcctgaaactatacttgtccttaataggacttataggattacaacaccgatcgaatgataaatttcagttatttttttcttatctgcctgaaataaatacggatctcttaatacccttcacattggccagaaatgaagtatcaccggaatcgaaacaataaccattactatctcgagcggtagcccgagtttccaataatccccgaatttgagcccggccggacccataaccaaagcattcgactgatgacccaccggagtcaggaaagcactggaggctccaaccacgatagccatcaggaagggatccggcgaaaccccaagaccggttgcaatactaaatgatatcggagccatcaggacggcagttgcggcattattgatgagggctgaaagcagcatggtcacgataaggataattgtaagcaggatcaccggtgaaagaagattctgaaatgataacaacgttgatgctatcagttctgctccgccggtctcctccatggcctgaccaaccggaataaatgcaccaagaaggatgatcaccggccagtcaatactctcgtaaatctccctgaccggaacaagggaaatgaggaccatcagcaatgcagcaagagtaaagatgacctgaaccggaacaatcccgagagctgcaatcacgattgtaccggcaaagataccgacggattcgatgatccgctttggctctccaatcttgaggccccgctctgcaagagggaaacacccgagaattttgatagcttcccgaagtgctccctcggttccctgaagtaataagacatcaccggcctgaaacctgatatcattgagccgttccttgagaagaactccctgtcttgctactgcaagaagattaattccgaaacctgccctgagatcgatatctctcacattcaaacccaaagctggagaatcagccctgatcgtgccctccatcagaatcctgtcaccagattcaatagtttcccggtctaacgtgacatgttcctcaagttgaaacccggttgcaagaagaaattttttcagatcatcaagagctgcctggactatcagaatatcatcggcttttattcgttcatacatgtacgggaccggtcgtgcaaatgatccccggataagctggataatggtaatttttgcattggttgccttaatgatctcccgaagtgccttcccggcatattttgattcaggtggcacccgtatctccgtaagataattttgaatcgtgaaaaaatcatccagtgaacctggtccggttcgttttggtaccagtcgccatccgatcagggcgataaagaggaaagagatgaacgcaaccccaagacccaccggggtaaaatcaaacatggcataggcctgcccgagatgttcctcccgaaatgctgagatgataaggtttggcggtgttccaataagggtgatcatcccgcccagttgtgatccaaatgcaagtgggaggagaaggatggaaaccggtaccaggctggatcgtgccattttaattcccaccggcatgagcagggcaagggctccaacgttattcatgaaccctgaaagtgtgataacaaggccggtgagtgcagagacctggatggttggccgttttccaaccttcataagagctcctgtaatcatctccaccactccggcattcaaaagtccccggctgatcaccagaactgcagctacagtgatgactgccggatttgcaaaaccggaaaatgtctgggtccagggaactactcccagaattgcggatacacacaacgcaagaagagcaacgatgtcatatcgcattctcccatcgataaagagagcaagagaaaggatgaggataacaaaaacgattatctgatcagctgttaccgacatcatttcttatacctgttgtgataattggaactaaaaatctctgattcctttattcttgcacactaatttggttatggtatgaaaatggatattatactggccagaccggccagatgatctttccgtacacttcattcagaacctgggcaagtccggtgtagattgctgaaaacccacagataattccttcaattcctgcaatctgtgtgatagtctcaattccggtgatatcaccaagagcaaggaggaagaacaggatggtcagggagccgaagacaaattgcaaagctctgttcagtcgtaatgttccgatgaacatgattccggtgaagatgccccatatgataaggtatgaggccatggcgatgttgcctccggttccgtccaccagatctgccgccggtaacaggagcagcatcaccagggatatccagaaaaggccgtaggagagaaatgcagtcataccaaaggtattattcttcttccattccataagtcctgcaataatctgggcagttcctccataacatagtcccattgccaatatcatggatcccagcgtaaataatccggcattatgcagattgagcaggacggttgtcataccaaaaccaagaagcccgagaggtgcaggatttgcagtaagttcagagacgatcattgatcctgtttcactgatttgtgtcatagtgcctcctatagtaatctggtcggattgaagagtgattatcctgtaaggtataagaggatatggtgagtatttgatgtggtacctggaaggttttttgcccctgtacatcaaataaacgggaggtttttatatgaatcctgaatggtgcaataggtgttgcaggtgagtgacccaatcaattctgtagatagaaacggaacaaaacggaaatacattaaacccggtctttccgtagatattatcctgaaacaggatcagcgaactggtaagaaaactcgcggtattgtcagagagattttaaccggttcatcatttcatccgcatgggattaaagtcaggcttacgtctggtcatgtcggcagggtttgttttatccatccggatagcccctgaaaatttatccgagtccgtgttctatcaaatccggataagaaaacagtatattgaccttaaaccttaatttttccgataatatatatttcataaaaaccacatgtaggcctattctcaagggcatcttcctaccgtatgtctctatggaataatcctgaggtccttatataatctctctgttggattcaatattgggtcgctattatcaggttaatagagagttttgattgagtgttttcatgaagatatgaggattaaatggggttgtgggcagtctgatataaatgctattgtagcattaatctcattgtaacaatttatattaaaaatcaaataaatcttttaatatctttatttataaaaaataacccatttctagagttgggttacataatctgatgcctatacctgggtagagccggtgaaaggagtaatatctgaccagatgatgtattgagatagttccattcctttccaaaggatactttcagaattttgaagatgctttatcgaaattcgcaattttttacataaggccaagtagacaatcagttcttttattatctctgaggtattattcagcatatacctgataaccaaaatttctcagtctctatcacatttgaatttcatggtaccaaaagagcattcagagcaggactattctgcatcagttcaggagatctactcccggtactcttccggcccctccgggctcgatcctactgaatgtcttcaccgtctcactatttatgggaaaaataccctgatccagtcaaagaaaaaatcggtctatattaggtttttcgcaaacttcacgcatcttatggcaatcctcctgtggatcggtgggattgtcgcactgatcgcacacatgccccagctcgcagcagcggtgtggatggtaaatattatcaatggtcttttctccttctggcaggagtttagagctgagaaggctgcggatgccctgatgcagctacttcccgtaaaggtccgtgtcattcggaatggtgtcactatcgagattgcagccgaagatctggttcccggtgacctcatggtccttgcagagggggatcatatctctgcagatggccggctggtggaagcatcagaactcaggattgatcagtccacattaacgggtgagtcccatccggtaaagaagactgctgatccgtcatatgagactgatatctcaaagattgagtatcagaatctggtctttgcaggaaccaatgttgtgtcagggactgggcttgcaatagtcacaaccacaggtatgaccaccgaatttggaaaggttgctcatctcacccaggggatagaagaggagaaaagtcccctgcagcaggagatggtgcatgtcaccaggatggtcaccattgttgcggtcagtatcgggattctctttttcatcatgctcatgactctgacaaccgtcacccttgctgaaagttttatttttgctctcggcatgattgttgcattcgttcctgaaggtttactcccgacagtcacccttgcgcttgcacggggttcgcaacggatggctaaacgaaatgccctgatcaaacgattatcagcggtggagactctgggctgtaccagtgtcatctgcactgataaaaccgggaccctgactcagaatgagatgaccattacccggatatggatccctggttctttcttttcggtgaccggagtcggctatggccccgaaggtgagattactcctgacgaaccggcgaatcagaagaatatggatgctctcagagaattgttcatagccggtgttctctgttcaaatgcacggcttcttgctccggattctgcaaatccccaatggaatattcttggtgatccaactgaagctgccatccttgtcgcagcagaaaagtcaggagtatattatgaagaggagagccaccgattcccacgggttcgggaatttccctttgactccagacgaaaatgcatgagtaccctgcaccttgcagagaacgatctcatctgttacctgaaaggtgctccaaaggcagtccttgacatctcttcaatggtgatggagaatggagaacccgttttgttaaccggggagaaacgggccagaatcatggaggtgaatgactcctttgccgagcagggacttcgtgttctggggattgcccggaaaaatatccacggcgatgttactccggaaaatgctgaagacgtggagcatgacatgacattcctcggccttgttgccatgatggatcccccccgtcctgaagttgcattggccgtgaaaaaatgtcatcgtgcctgtatccggattatcatgataaccggcgattatgggcttacagctaaaagtattgcccgtcgtattggaataataactagtgataccccccgtatcatcaccggggtagaacttgatcagatggacaataatgacttaaaacaggctttgtcaggggaggtcatctttgctcgggttacccctgagcataagctcagggtagttgaagtcttgcgggaaactggagaaattgttgcagttaccggggatggggtgaatgatgcacctgctttgaaaaaagcggatattggggttgcaatgggaatatccgggactgatgtagcgaaagaggctgctgacatggttcttactgatgataactttgcatccattgtcaatgctatagaggaaggcagggcggtctacgctaatattaagaagttcaccggttacatcttcaccagtaatacccctgaggcggttccgttcatcctgtttgcattcagtaagggaagaatcccgctggctctggatgtgatgccgattcttaccatcgatcttggaaccgatctcgttcctgcccttgcccttgggtcagaaccgcctgagccggggattatggataaaccacccagaaatttgagagagcatgtcatcacccggtcactcctatttcggtcctatctctggcttggaccgatacagagccttgccgtgatgtctgcctttttatatcagtactggacgaacggatactggggaagaattttcgacctgcctgcacaaggccctctctatcactcagcagtaggaatggctcttgcagcggttgtgaccacccagattggtaatgtccttgcacaccgaactgaacgaagttctattcttaaaatcgggttttttacaaacagaatggtttgggctggtattgtcagtgaactcatcattattatcatcgttctctatattccgtttttccaggaaataatcggaacagctcccttcccggtagagaactggctgtttctgtttgcctgggcaccagtcttgttactggcagaggagttcagaaagggagttattcgtatgattgaaaagaaaaagggagtgaataatccatcaggagggatagcatgaagataatcatcatcggatgtggccgtatggggtcaggacttgccatgcgtcttgtacggtcacatcatgaaattacggtagtggatcatgatcaccgggcatttgaccgtcttggggcaggattttccggaatgataatagaacatgatgccatggacaaaaaatcatttacgatgagtggggtagaaaaggcagatggacttgccgcagtaaccggaaatgatgcagtgaatattgtcgtcgcccgtgcggcaaaacagatgtaccgggttccaaaggtgattgcccgaactcatgatccccgatatgcagagctgtatcataaattgggtattgagacggtcaccaatgtaactcttggtatagaacggatatcagaacttctgacattttcaactcttgatattattcatggaatcggagatggagaagtaggcatagtcagatatgatattcctccgctccttgccggacatcaggtgaaggatctgactgtcccgggtgagatcattgtcttgtcactgaccaggaaggggaagaccagcattccaacccttggaactacactggaaaaaggtgatgtggttcacattgccgtggaagagcgggctgttgaccggttaaagaatgaaatgcggaccgtcggaggtggataatgagtctttctgtattgattgccggtgggggtaaggtcgggacctatcttgcaaagatcctgatttccaacggtaatattgttaccatccttgaaggagcaccagaagattatcataaactcgaacaggaatttcaagagggtcacctggtcaaaggagatccgaccgatccacaagccctcatagctgccggaataaaaaatgtcaatgtggttgcggcagtcaccagacatgacgagatgaacctggtcatagcaagccttgcaaaatttgagttcagggtgaaaaggactatcgcccgggtaaacatcccgaaaaatgcctggctttttaccagagagatgggtgttgatgtcatggtgaatcaggcagatctgatggctcatctgattgcacgggagatgaccgtcggtgatatgatgacaatgctcaaactccggaccggtgaatactcccttgtagaacacatcgtgaccagtggatcggccgcatcaggcaaagcgattaaagatctccacctcccacaggaatgtgtcctgtctgctatcatcagggatcataaactggttatcccacgtgggaatatcgttcttcatccgggagatgaggtcctcaccgttgctcatgaatcggtaactgcgcaggtaagacaggtacttcaggacccctccggatgattatcagttcctatctgttcatcacctggcaggtacattactatacatgaaatatctgatttttgatacagaatccactggacttcccagagaggagaaagatcccttccattatcctgaatactggccacgtatggttcagctggcatggattctgactgatggtgaaaccattatcacagaggagaattatcttatctatccggacgggtttgttattccttcttcctccatggagattcatggcattaccaatgagcgtgccagagaggaaggaaaaccggtacttgaggtcctttcagtattttcagaatcaatcaagcaggcagatgtcctggtcggtcataatgtctcatttgaccggagcattgtgacatctgaatattcacgtgcaaaactgaacgcacctatcctgaaacttccctatcattgtaccatgaaaacgtcgacagaagtctgtaaattacccgcaaaagggggaagaagaggatataagtggccgtcactctctgaacttcaccagtttctgtttgaagaaccatttgaacatgctcatgatgcaagtgctgatgtaagggcatgtatgcggtgttacctcgagctcaaaaaccgtggtctttttcaggaactctggacaaaacctgatccaaaagagatgaaatggaagaaaagaaggaataatccgtattattgacctgatttcccaatgattccggaaaaaattaaccagttattcaaatctgtattttccatacggaacgatcaattcaaaccgtgctccctgaccaaatacccctgtctcctgaatcctgataccggtgattgccagtacttcccgaacaaaatataatcccataccttttttcaagtcatttcttcgttggaacagtgtttccttctgttcatcaggaattccctgtccattatcttcaaaaataattttaagatcgtttccttgcatttctgtatatagatggagtcttgtaactgtatttttcccatgaatgaccagattcatggccagattgaagaagactttttcaagaaggggatcagcatacataaaaactccttttatctcttcaacccgttcaatatgggtgagatcgaggtgtgaaattgcatagaggtatacctgcagaacattctgccagtatgcaggtttgattcccatatcctgataatcctttgcaaattcaagagactgggatactttttttacaatactcttctccttctcaaagagtgtcagaacagccgggtcagagaccatatctttttgcacttccaaatatccggacagagtaaatatgtaattccttatgtcttcaaaagtgatggcattgagaagagtaagtttattcctggctttttctaaagcttcttcagcctttttccgatctgaaatgtcccgtgcgactgactggtattcagtgattgatcctgaatcatcgaataatccccgaattgttccattgatccatctctcctctccatcaggctggaaaattctacactcaaaaaatgccaccgggttatcagatgagagtgcggtgatttggttcagaatcccggaaagatattcttcaatttcctggatctctcctccttgctggaggatatcttccctatttaactggaagaaagaacagaaagcatcattaacaaagataatttttctttgtggtgtgaaccggagaatgagttctgtctgatcttctacaatattccggtatttttgttcgctcatccgaagttcctgctcaaatgttgcgagggtgttgtaactctctctcagttcctcctcatttgctgctaacttttcatatgcctcatgtaaatcagaatttttttgaatgagttcctgttcaaatctcttctgttcggtaacatcgacgagagttgcaagagtctgacctgttcccggcatctgggtaacactgatcatgatatccctgatctctccgtatcgggttttgaatctgaaattataaagcgatgggatgtccttttctcctgcctgccgtctcttgttgtactcaatcatccggtttcgttcttcaggatctgcaacaaactccacccatttcttctgcccaatcacttcatcttgtgaatatccccataactcctcaaattttttatttatgagtgagatggaaaaatctttttctacaagaatcaggggattttctgagtgttcaaatattgtcctgtactgttcctctgaaatacggagtttctctctggccagcgttaattctgaaattcgtaattcaaggtcaaggtatgattccctgaggttcttctgcatctgttcgattccacgggcaagaatgcctatctcatcagtacgggtaatttcatgaatgtctgtcaccagatttccctgcccgatctttgaaacggtaaaggtaaggttgagtaccgggtcggtcagataccgggagaggacataaccaagaaggcctgaaaagagcgccccgataataagagctgcaatggttacatgaatcatccggagaatattttcaaatgcttcagttgtggaaagttcaataatcactgcccagtctgttccttctatatcggcatatgatccgatcacctcctctccttttaatccgatatatggtgaaatattagtcctttcagatttttctgaaataacatcctgcaccggtggatatgcagtcattaatgagccataacggtccagtatatcagatatcttctgataggcaacaaacttaccctctttatcaacaatatatacatacccgctgtttccaagatcaatcttctctatctctgaccataatggcaaaacgctggcagttcctataagaacatgagtaattgctccctgatgatccgaaaccggtattgcaatatcaacggagattaaacctgtttgggggaatacatagatgggtgaaatgaccgtttctccttttagggcacggttaaataacgattctgttgaacgattaccaagttcatctggcatgtaggtataaaaacgtgataattttaaaacctcttttccgtcaggagtcaacacggtgcattcatgatacaattttctcttgtcattgaggaggtcaataagaacttccttttgttctttgatggataaggttgaaaaatgtgaactggtggataaaagcattagattatcagccagatttgaaaagtagtatgaaattatcagacttacttcttcagctgttttcttctgggtcaaatggatagtattcccctgctctgaatatgctatccagataactccacagccgacgatcataaccataaggattacaagaagaactatactcagtatggtccgggttgtaatccgttgcagataagggatggtatggggtgatgttgggtacgtcatggtttgtcagggttcgtggcctgggttgattctgcatatgtatcaggccatactgttgtccatgatccattctgtacctgcatcattgttaatctagaatattcattctgtccctcagagctgaaggagatataatcatctgggatgagaatatcctgatcggaagtaatattcgtctctgataatgcagttcggatatcttcactctctaaagatgcagccctttccaatgcatcactgagtaccagtattgtctggtaggtatgagcggaggcaccagaaaggttcacgccgaatcgtgcatagtatcgtttatttaagtcacggactgccgttagagaatatactaattcagatactgaatagatgccttcagcatcagggccgagagcatctataaacgcttgtgaaatggttcctccacctgaatatatcacaggtccggtaaaacctgcattttttaattctctgctgatgattattccatctttcagatatgttgtcgtaaaaattgcatcaggtttttcccgaacagttcttctgatctcttcaagataattgtccacatctgctgcaacatagctggtatcaatgggaatggtaaatccccctctcttcaaaaatttatgttcagcgatggctgcactggttccaaaggccgtattttcataaatgagtgcaacagtttttatcggattaattaatcttcggttcatggattcaagaaactcgactttggtatgtgcataatcatcgactgtgggaataattctgaatgtataggaatatcctctctcaataatgacatcagatattcccgtatttaccatgaaaggagtttgatattgctctgcaatctgtgtagcagcgatggccacattactttgatatgccccgacgagtgcagttaccgtgtgattcaggataaattctttcgttttcatcgcaccaatggttgcatttccttttgagtcagcaatgatatatctgagcaatcgtccttctttggatcgaatccctccgtttttattgatctcttcaatagccagaatggagccgttcaggcattcatttccacgtccggccagttcaccggtcaatggaaggagtataccgatagtgatggttttgtttattaccggagatttttcttcaacacacccgcatgacagaatagtgcatataatgaataaacacagtaaaaccgggtagtaccatggtatccgggaatctggatccagtcttcgtttcattgggtatgaatgataatcgacgaataaagtatatgtatatattcaaacaacataggggtgtctgaaatatcgtgccatgcctactgaacgtaatggtatcatccacttgaaaaatagattggtccatgacctgtacacctaatgtgcatcatattatgcacactctctgaattatttcagtaacttttcatcattctgtatttaattatttgcataatggttgacatatccaatcctttttttatgtgggaagtacaatcatacattacaatctcacaaataatggacggttgtctttctttggatcaggaacatccctctttgcatatatgacagtcattaaaattctgcttgttgatgatcaggaagaacttctggatataacccggatttttcttgaaaagggtggggacatcgtagttgaaaccagcacatctgctataactgcgatagaaatgctccgtgagcataaatatgatgccattgtctctgattatgaaatgccccagatggatgggatagaatttttaaaaaccatcaagaggatgggacttgaaaaacccttcatcatctttaccggaagaagtcgggaagatattgttattgaggcattaaattcaggggctgatttttaccttcagaaaggatctgaaccaaaagtccagtttgccgagcttcggaatatgattcatcaggctgtcatgagaaagaggatagaagaagccctcatccagtctgaaacaaattataaaacccttgtagaatgtactcaggattctatctacatggttgacaagaggggaaaatatcttttcatgaactctcatcacaaagcccgtcttggaatcagtgaccaggattttcataattattattatcaagatcttcattcagatgaagaaaccggacattttttaaaccttattaaagaggttatcgaagagagcagaccggttcatgacgaatatagaaaaggtgataggtggtttgtcagaaccatcagcccggtcaggaatgaaatccttgatctcaccattgcagctacggtaatttctactgatatcactcatacccggacgcttgaaaagacggtcagcaccctagaagaacattataaaatacttgttgaagccatgcaggactcggtgtattccgtcgatcctgaatgcaggtataaatttatgaattcccatcaccagaaaaggctggggattaccggagaatatatcgggacttattatggggattaccatgataaagcagcaaccgatcgatttgaatctcatatccaaaaggtcatcagtacaaaacaatcagtttgtgaacgatataccgaagatacccgaatctttatcaggacatacagcccggttctggaccctgaaacacagatggttcaggagatagttgttatctccattgaaccagccggcagatttgaaaaaacctaaacagataaattgagtttttttccttaccataaagctctttggaattttcattccctgataatcacatcctcggtttcggtaaatggatttgtccgtactgcgagagaatgcaaataaggataatgaattttcagatgtgcgagatatgagagccagaccgggatcatcatcgaatatgcccgggtaatatcccccgaaacatgatccacatcactttcgggtaggtttgtacactctccccggtgcttaagttcttcggtcaggtgaaaaactgcctgcaatacatcggtgaaagattcgtgttctaaaagcaccgggttttggagcattctaaccaggagttcttctttcatcaccagaagatttcgcaggggaatcagttccgtacaggtgatggtgatcgaacaaggcaggttcattatctctttttgttttttttgatattgtggtgtatcccatgttttcatcgatgaaaaaaaagttatcttttctgtatgatccctgtcatgttcagaaaaatacctgagcagcggagttccgatctctgaaaaaaatactccgattaccatgttcagtttattgagtttattcttcatggcccggtactcaagcatctgatgtaaaatcagggtaacaagaaggacttctaatggaaggaaagcaaggtcatggatggtatagataagaatatgatgaatatcatgaaagatcatataatgaagaagaaaaagaaggaatgatgaacagcataaggagagagcaaacaatatcaaccagtttctgttagaaatcatctgttatgtgtatcatcttatttcctgatgagtatttcttcccagagaaaaaaggttaggcagcatagatatctcccgccccggtcgcataaagccagtatccatgtcctgatttgagaaggcggtcatccgaatgaatccctgagcccttcctgattatcacgtcctcgtatttttgcatactctcatcatatccaatgagatatgtccagctgtcccccagagtactcattacatccttagctttaatcggtccgattcccggagatccgatagcgttccatccaggttcaaccgttttcttcccgccactaaccggatctagccagagagttgtgtccacccggttcttggagtaaatccagtaccccgtcaccggatgcagaactgtatccctgtttacttttgtccagccccatgtctggtttggaaattcgaatattgagtgcccgctggtttctatggatccaaatagtgcggcagtatcacttcctggtgagagtgattttggaggagtgaagaaattccagccaggcatcaaggtcaagatatatttgtttccggtgccggtgaccgtgatatatgagagttttaattcggcatcactccctttcgggccggtaactgtcaggtttacattatatgatccaatgttctcgtatacatgaacggggtgctgctcggatgaggacgtaccatctccgaaatcccagagccagctctcaatggtgccgagtgaggtatctctgaactggacagtcagtggcagactcccggtccttggttcagcctcaaatgatgctgatggaggcacggaatcgggaatagcgagcggtagttcatctacattgtctcccccaatccggtagacctcatcacaaaaaccatcgccgttttcatctttgtgcgtctctgaaaatccggttccatccggtgtagcccagaaattaccgccgatatacgggccaagaacaatatttggtccggttgtctttggaatattccaggtaactttcgtatctggtgtcagtgcaacattttgggaattattcaggtaattatcatagatggtcatccccgttccggtaacagaaagtcccgtttttttattttctgcgattgcattgcctttgagaacggagttgtatgcagatacaagcctgaccgctgatgaatcttttgtccagacaacggtgttatttgatatatcaagatatgaactggactctccgtagattgcattgctggttgagttccagatgatgtttccatcaagaattcctccgacaacactttcaaaccttactcctgcgtaattctcaaagatccagttattcctgataaccgctttattccctctgactgcaacaccagggcggatggcagtttcagaccatgctcctgtcagggaaaagttctcaaccgttactccggcggcagtgatgctgactggtgttccggtaaattgtgcatcaatgatcggtttttgtccatcggaactgctctctccgataagggttatcggtttgtttatagtcaatttttcaggataatacccatatctgacgagaatcgccgatcctggtggagcggtgttgatcgcttcctgaataagcgaatggtcatcgggaacgattatctttgtcggttcggagacggttatataattcttcttaaccatcatagattctccggccggggtatcacttgtgagggtgacggagtatactccgttataggtataagtatggatgggattttgctcagtagaagtagcgccgtcaccaaattgccagagccagcgttcagggtttccggttgagatatcatggaacgttaccgtcagcggtgcactcccactggttggttctgcgtaaaaatctgcttttggcccggaaataagccggtatcctgcccgaatacatgcattcccctgaggatcccaggttgtcagatcagaccattttccagtggatgttttcacataactctgtccaggctgtgcagtcgctttgctgctgtaccctggcaccggatattcaaccgggataggaaatccatagtccggggtgttaaaatcaacaactatagagaatttctcacctttctttacctttaccgggagatcaaattgcagtgagtggtacccgggaatctgatatacttcaccatttgacgttgccaccggagcgcttcctaccggtccattatctggattgagatatactgatgcggtaacactggtaccgacctgtgggatgtaaaacccggcactcgtaacctcgatatcagcatcagcagtgaaaacatttgcagcagaggcatcggcaaatccaaatccgaaactgtttacccagcctaatgtgtcatagccataactaccgtcagtattgtcggttgctgcagtaaatgcagagatccgctttgcaatcagagtgtcgtaatatgagatataaaagaaccctttatctccccagtttgtaccccagctgtttgcacagataaatgccccgtctcctgccggttcagtattaaaattcgatgcaggataggtatcatcccagccgattatggagatcgcatggttgggggttgttccatcaggattataatacccatttgttccggtattgaagtactggtcatcatagaggatagttgagtaaagacagccaagattcaccagagcccattttacattttcattatcggtcggaccggagcgtccgggtatcatcggaacatcgctgacccgtgtctctaccgggagattctggggtgaaataaaagaatacggattatatgggtcaagtttttccggtaccggcccagaaccccgaaggaaataggcggcagccatgagatcatttcccccatcggcaaagtcgaacccttccggatcatatatagagacatggtttttcaggttgttttcagaaaaatctttggcaacttcaggaagaagagatgattcaagagattttactgcagcaaaatcccagcagctcccgctctgcccctggtcacggatagcagggacccgttttgaatcccgaagatcaaattttgatggataatctgccagaattgacagacttcgaatcttctttcctatcaggtgggagagatccacggggctctcccgaagcggcccgcttccgcagcaatattggctgtctgctgaggtattctcagattctgttatcttctgccattgaagtgacaagggagcaaaccccccctcactgaaatcctctccatccgcatagcagtgagtccctcctgctattaatgcaataataagaagaatgcacagactcttccctgaccacatccacctcaccttatggtatattaggtaatcttacataagtcacctttcataaaaaagaaagaatagattaatcctggtttggatgaggtgaggaggattttaccatcatgaatatgataacagataccatcaatattaccggaaatgtttcaaggcaggtgtacagtcctgccatatcagcaaccgctcctgatatcgacaccccgattgctccagcacccatagcaattccgaggaataatccagaaatcagccctatcttagagggtatcatctcgtgggataatgcaatggtgaccgagaaagacgaccagagtaaaaatccgaagatcatcatggaaagaatcaggaacagtccatgggtcagaagaatagcgatgaatgccggaatggatgctaatgtggtgaaaacgataacttttttccgtccaatccgatcagacagggcaccacctgataactgaccggcaacacctgctatcatcatgatactcaccagtgtagtcgcttcaaggagcgaatatccttcaagcaccagatatgtgggtaaaaaggtcatagctccaaaggtaacccatgatcggagggtagctccagtgaagaggagcatgaccggtctccagttctcctttccttctgatgtcttctcctgttttatgttacagcaatccgtaatcgggtttacgtgcaggaataatgcggttgcaattgcagggacaatcagccagatgacctgaggtactcccccggttgtcaggattatcccggcaatgatgggcccgagagccattcccatattcccacctaccacaaagagcgaggtaagtttccctcgggaacttccggttgcaagaatactgacctgacagagagcaccgggatgaaaacttgcatgtccaacccctgaaagggctacacacaggagcatgatataatactggtttggaatcagaccaagcacagatactcctataccggagaggaggatggaaattccaatactgactttaattcccttgttatctgccagatatccaaagaggggttgtaagagtgatgaggtaagactatgaacaaccgggagtaatgcagcctcaaaatacccgtatccatacatggtgatcagcaccggctggagtgccatcaggataggagcataaatatcattgatcaggtgggcgatggttagttcaccgattctccgaaaagcactcaacagaagtcccccattgattcatctgtctcattccgggcattatactgcataagttctcttctgacctcgcagagtcgttcttcatacaccgattccatcgcctggaggaccttcttcattgtgtgtatatctttggtttccagagggtctattcggctgataatccgctgataaatttcttcatggagcgtttcatgatgccggtatgctttctcaccaaggggcgtcagtgacaggaatacttctttctcattctttactcccctacttttagttacaagaccacgttttgccaatttcgtcacctgctgagaggcagctcctggtgtaatcccgagaatatctgaaattgtccggatattagactctggattagcaccgattgcctgaatcaggtgaatgtctgatggtgtcatcagttcattaatcccataatttcggggcagtttttctgattcgcctaatttgttcatgagacgcatccagacctggtacaggtcccggatattttgattatcttccattttccttagttactatatgatttagtaactatataatttatccgcaactcttattcaggagtttataataagcattctaaaaaagtgttttttgaaaaatcaggaatgtttttcccaccggagaagattcatcacctgtgagagtgtttttccctgtttgagttcctgccttatccgaagctccgtattgtaaacctctttggcacgtctggcaatctcataggctctggtttttgggatgacaactacaccactttcatcggcgatgatccagtctccggggttcaccgtctgcccaccacactggatttcagatccaatctcaccaaatccttttggttctccggcattcgggaccattgccgtggaccatagggggtactgcatctttttgatatcatcaacatccctgactgctccatcaatgataacaccactaatcccccggttcagacaggagatggttgcaagctctccccagggagcaacatgtgttcccttgtcgttgttaataacgatgacatcacctggtaatgcgatatcgattgcctccaccggttttgcccaatccccggcaaaagtctgcaccgtgaccgccttcccgactgcttttgttcccgggcagagcgggatcattcctgacatggctcctttccgatgcatggcatcagatacattggatgatgagacatacctgagaatctcccgaatttcatcttcctgagagatgtcagggcctgcatagggaaccggctgattcatggcctccttaattctgcgcgtagaaccggtgacatcagatgacctgataatggatccaccgacaatgacaatggaggcccctgcagctattgctccaggtgctgttttctctgatattccaccggctgcagcgactggtatgctcacttccctgataactttcatgagaaggtcaagtgagtctgtcccggtcatctgctggtcaataccggtatgagcacagatataatcaacaccaagctgttcaagttcgccggccctgcctgaagggtttggaacggagatgaggtctgccatgatcttcaccccatattttcgtgcagcccgaaccgattcggcaatgacagaattatcagaggctccgaggacacaaacgatatctgctcctgactttgctgccatttctacttcgattgccccggtgtcagcagttttcatatccgcaatgatctgccggtcaggaaatgctgatttcaatgcggacacggctctcatcccttcacttttaatgagcggagttccaacttccagccagtcagcacctccgagaacagcttcaccggctatggtaatagctcggtcaagttcaaccagatccagcgcgacctggagtacagaccggttcataggtacacgttaccggtatcttggataattgttttcctttttatgattgtatgccctggaataatgtctgccatacccctcggggaagatacttaaatctctctgaatttatagatcctattacatacagtctgaaccggctgtctttgtgggggatgaacatgcagttcgcgcattttcgatatctgttaactcttataatattgaccggattatcgttttcaggtttgatatccggagtatatgctgatgaagtatctgaatcgtcaaatgggaccggagagtcagcacctgctccgtatgtgcccggcgaagtcattgtaaagtataaagacgggacagttgcagcacttgcagctgaaggatcaggaccggttgctcttgaggcgctgggggcagaagtagcaaccgatttttcagctgagggtctttccaatcttcaggcacttgatattactggcccggtgtctgtaaaagaggccatcgcagaacttgaaagttcaccatatgtcgcctatgctgagccgaattatatcatctcgttatcacttccggagacagagccggcaggtcctgatgagataggagcgctttctgccctgtcatttccgaatgatccaaaattttccgatcaatggggccttttcaataccggccagaccggggggattagtggtgctgatattggagcctcaaaggcctgggacattactaccggatcaaatgctatagtagtagccgtcattgataccggtgtggattataaccatccggatctggcgggaaatatctggacaaaccccggagaaatccctaataatggtattgacgatgacgggaacgggtatgtggatgatgttcacggatatgactttatcaacaacgataatgacccgatggatgacaacggacatggaactcattgtgccggagtcatcggagcgattggaaataacggggtaggaattgctggtgttgcctggaaggtaaagatcatgcctctgaagtttctgcgggccgatggtaacggagatacagcagcatcactcaatgccattgcctatgcacgacggatgggagccaatgttatcagctgttcatggggtgggaccgcaaaaagtcaggcattaggggatgcgattgcttcaaccaatattctgttcccctgtgctgcaggaaatgcgggatctaacaatgatatcacaccgcattacccatccggctttgattcaccccagattatatcagttgcagcatctgatgcaaaggatgggataccttcattctctaattatggcgcaaccaccgtagacgtcgcggctcctggagactggattatgtctacgtatccgacatcactcggtcatcagtatgtgaagatgaaagggacctcaatggcaacacctcatgtagcaggtcttgcagcccttctgctctcgaagaatccatccatgactcctgcagctctgaaggctaagataatggacaccgtcgataaactccctgcattctctgggaaaacagtttctggtggaagaattaatgtttataaagcccttggcggaggaggttcttcttcgggtgttgttgcccttccgggtatgagccagccaccaaaagacctcaatggtgacgggaagtatgaggatgtgaacggaaatgggcgtgcagattactcggacgtggtgaccttctttaagcagatggactggatcagtaaaaatgaaccggtggcagcatttgacttttcaggaaataacagaattgattatacagacgtggtcaagttattccagtctatataatggtaatggacggtaaaatcaagattggattattcaatcccttatttttcttccggtgaccaccggttggtaaagaagatctcttttcccggttttttgcttggaaccttcacttctttcgggtaccctgccggaatgagtgatgttaatgaataaggctctggtatctccagaagtttacagatatcagccccatactcttttttatctccggcaacccagcaggtcccgacaccataggactgcagacaggttatcatgttcatggttgctgcacagcagtcttccagataatatttcgcatttttatccccgcatatgacaaaacaggctgctgcttcagcgatgaacttcccatgatcggtaaaatctgcaatttttttcagcagatcacgatctgttacaacaccaagaagccagggctgcagattcattgctgtcggagccagacgaccacactcaagggtttctttaataatttcatcgctgagtggtttgtcaatgtatgatctgacgctccgccgtgatttgataatcgtcactccaagattcatagtattcattattacttatcattgaagataattatcggtccctgaggggtatcatccgctccaggtgaattcggaaaaaaggttatccaactgtccaggattcaatatttcgcgtttcaggatcaaacaggatgccgacctttatcttctgccgggggtctgaaaggtacttttctgcatatccacgttcgtcaatttgatcaagtggatccttttttcctttttgcccgatgccctttactttgaattcgaagatccagatatatgagggtgttttaaccgtcagatctatccgacctttattcgttgtatcttccgggattacctcgaaccctagacttgcaagatacgaatacatgagacttgcccaatacccttcgaatcttgcaaggggatttcttcggtaccagtcatgaggaattgatgcgaagaaagactgaaggtgagcatgtaatccttcttcatcccccagttccaggatcgaaaacaggatatcacgattatccgagagtgaataaccggaaagagcctcagagaacagcaggttgagagacgttctcacttctttgtttggatacccgagtgtgcatcgaaatccccggatgccgtcagatgaccaggatctgatggtgaggtatccggtctgaaataataaggtttcaaccgttatcttttccgggttaaatgaaaggagaatatcatcacctgatatcattccgtcatactctgcgggtaatcgtggctcattcagccagttttttagcagaaatgatggtgttcctgtctcgaaccagtacggtctgaagatacctgaatcaaaaaacaaaagaatatcaaagggattatagactgatttaccggtccaggagtacccgttgtaccaatcacggatgagatcaggatcatattgttcataccagaatgcgaaggaggtcctgatgtcctcttctgtatatccgcagatggtggagtaccgggagtcaagggttatgtcctgaagattgttcagaccggaaaagataccggttttgataaatttcgatacaccggtgataaaaacaaacctgatatgagaatcaagcggttttatgaatccataaaagtcacgcaaaatatcccgcatatcagccgcacgaacaggatcttccagggtgtcgaggataggcttgtcatactcatcaacaaggataacgatctgttcacctgttttcgtgtgaatatccctgattaatgatgaaaatcgtccgccaatcgatgtctcaaaaggttcaaaattccaggtccttgcccaggcagagatgagctcatgtatctgtgttttcaactctgctggtgtccgtggggatgagagtgaccagtctatccggaggactgggttcctcttattccagtcccactttgaatccggactgtccagaaaaagtcctgaaaagagatccggtttctgtgaaaaagccgcatcaaacgtatcgatgagaagactttttccaaaccgccggggacgtgaaagaaaataatattttccggattgtactaatgagtgaatcagaggtgttttatcaatatagacatatcccccggttctgatttcagtaaaagactggatacctatcggtagtttcagatgggacatctctttcactactatctattggctggtaaaataagtattgattgagagggcgatgaaatccggtacagaatacattttcagggttttatcagaaccatcagaacgaatcctgctccaataattgatagtataccgagaggggctttggtaggttcagggactggtgttgattcaggtgttttctccggtgttggttcgatagtttgtacggttgtataggtgggggttggaacatgcgtgaacgttggtgcagggatctgtacctgtgtctctacagtctggaccggggttatgggttttgtaaccggggctgaatatgcgggaggtgttgtttgtgtgaccattggagttatatccggttcgggggttccgatctcaatcgctactggtgctttaatgaggggattgatattctgaataagaacttccaccggagatgatatccctgcccccgtatccggcatattatccttaatgcggttcattgagagttctgcctgaacggtccaggtcccgacggtaactcccccggtattccagacaggaccggtggaggttaaagatgaggtaagcggaatcccggacagactgaaagatccggacgggccggacacggaagagtattttgcaccttcaggactggtgagaacgatatccacctgcccgtccggacctccccgggaatttgcttcataaacatttgatgatatccggaatgataccgcatctcctcttgggatccattttccggttgcatcaaaatccgcagtctcatcataaactctgaccgatacctgtggcctttttacctggaataccgggctaccttccggccaggagtaccagagcccctctttcccggaaaaggctgatggcgaaacataaaatgagtcaggggatgataccgtcatgagttccgtcgggtctgaactcctgctgctccccggagcccaccatccaatctgccctccgttcataacaccggttgcagaaatgtccagtccttcttctcctagaaacacggtccctcctggtgagattgttcttaaatctccacttgcctgtgatgcgcagaagagaatcatgagcaggctgaaaagcccggctagagaatatttcataatgaacaatttcctttatagtttaaatttttcttcacccatctcactaaatagtcttcagatcaagatcggtatatgggaattgccttttttgctggtggctgtttctggggcattgaagcaggatttcagaaagtgccgggagtaatcaataccaaagtcggatatatgggggggcatacaatagaacctacctatcaggaggtctgttcagatacgaccggtcatgcagagacaattgctcttgaatatgatgatacggcaatcacctatcgaaaacttctggaaattttcttctccctgcataatccaacagaagtaaacaggcaggggcctgatgtcggcagccagtaccgctccgtcatcttctatacctcacctgagcaaaaagaggaggcagaaatgtttattgcggagatgaaccagtcaggccgatatcatgccgcaattgcgacagaggttgttccggcagaaactttctggcctgcggaggagtatcatcagtcctattttctgaaaattggtcagcgttatggacggagtctgttctgatatgaaagaccatctgtgtaataccaaaagaaagagtgtggttgtactttttctgctgatttgtatcattatcgggaatgtttctgcagttccttcggatccacggggtattatcctcatctcatgggatggcatttctaaagataccctccaaaatcttcttgaaaccggctctcttcctcatctctcctctcttttaaaaaatggcagttttatcaatatctcaataaccgatcactatccggataccatggccggtcacgcccagattctgactggttattcaccggaacagaccggagtctttaaaagtatgcgatatggcgagatccctcatgggatgacggtatttgaacggcttgaagatgcatttggatcaggtaatatcagtactgctattgtggcatcacaggagagaagtcttgggacgctcaaagggctgcccttttatcatgcaggcaaggtggttgattattactatgaccggaacagtgatgcaggtctagtcgggtcggttgcatctgaatcagtctaccatttcggatctctgggtcgcttttttatcttcgctcacttcagggatgcggcagatgcagggtatgcatacggggcaggatctcctcagcagattacggcaattcaggagatagacgaagcgaccggaaatattcttaaagccctcaaggatctggggatttctgataagacggtattatatgtcacgactgatcacgggttcaataccggtcccaaagatcataccggacagatatctctctggatggtgaccaatgaaccgggatataatttgaccggcgatcagaaagatatcacaccgacgattctgaaaagactcggtgtttcgtatgatgagatgaacccgtcgtataatgcaacggctctcaacccctgatttttacagaaaagaattcctagttcttcaatgaattgtgaactctggaacaaataataactttgtcgaagagaaaaaagaaaagagtttagccgaacagagcaccaagccctgccattccgctctcttcttctgccttcttgtcttcagctggtgcttcttctgctgctgctgctgccggagctgcacctgcaacaggagctgctgcaacagcgaccggtgctgctgctgccttgctgattgcatcttcaatgtcgacaccatcaagggatgcgacaagtgccttgacacgtgattcgttgacagcgataccagcggcagaaagtactgcctgaacagaggattcgttgatctcctttcctgccttgtgcagaaggagtgcagcgtatacatactccatgttaattcacctaaatatttttccgattactcgtattgttagcatattgattatccgacaacattctggagggccatggcctgagcctgtgcctttccaagaacagcatcgattatgtcactactggtgactgcagcctcgacaccaactccgcgtgcttcacggacagccttggtcagcagtgcagatgcggtatccctggttggatatgcagcattgactgacagattaaaggcgtgggttgcagcggtgataatgctgttatagaatgcagtctcgtcgattgccagaacatcagactcgtagatacttccttcgtagaaggctgcctgcagaataagaccgacatccatcggttttatatccagctttgcaagtgcatctgcaagttttttgttgatctcctgaccggcttttaccacagtttttgtttcacgaatggtaacttttcctgcctcaattgctgcaggaatgccggcctgctgaagctcaccgacaattggacctggacggaaactggtcggtccttttgaaacgacgatatcttccggtgcagtctctccaggacgtgctgccatctttgtttttgtcttttcaagcatgctgtagagcttgaaaggattctcattggtaaagatgagagcagaatgtccggataagtgtgaagagaggtctgttatggatcccccaatctcaccgaatgcgtgttcgatgagcgtgttacgggtcataatcaattcggctttcccgcgaagatttcttctgatatcctgcacctgtctggctgggattccatacatatcaacaagtcctaccagcttatattcgctggagagacgcttgatagtggtaatctcatccttcttccactggggcagatgtgcggtatacaatgccattataactccaccttcacagacggccccatcgttgtctttatatagaccgatctgacctggaagtcacccatctcaagttttgagagaatacgcttgaggactgcatcgatattctctgcaatctcctcttcactcatggcggttgttcctaccttgagtgagaatgacatcttgtccttggttctgattttgacagatttccgaagacgctccacgattggacggatatccgtaccggcgggaatcggctggggcattctgcctcgtggaccaagtcgtggaccaagccatcttccgacaagactcataacctgcgtttctgcaaggaaaaactgatgctcggatgcaattttacgtgcttcacgaggggcacctccaaggcgctcaatttcttccggtcccatgatgagttcaacaccggattctcgtgcctgagtgacaatgtcaccagaaccaagaacggcaatcttgactactcgtccattcccgtggggaaggaggattgtctcatcaatacggtttttcggctgagacatgtcgatatttttcaggttaatggtcatatcgacactctcggtgaatttccgttcaggcgcctgttcttttgcctttttcaatgcgtcaataaggacgctcttctctaccatcaggttcctccatagtgatgcgaccgtgattgattccacgatcttctatggttacatatcgattctatcccacgaggactgcgtcatgagcgcccgaatctatctctttgagcatatctttgggttttttgcctgaaactgtaataccgagcgatacgcaggtaccgacaacttccttgaccgcattcttgagatcataggagagcatgtcatcaagtttcattttggcaatcgtgacagcagcctcaagtggcacgtccccgacaatcttggtgttcggctcaccagagcctttttcaacgcctgcttctttcatgatgagcgctgtcgtgggtggaataccaaccgagatggtgaagttcttcttctcgtccacctctacacggacaggaacctgcataccattgaaggatgcggtttttttgttaatctcatcaacaacagctttgacgttgataccaaggggacccagtgccggaccgagtggcggaccagcagtggctttgccaccgggtactagtacctcgactacttctgccattgtgtatcaccagtcaggacggttatgtccatctgggttcataaaggttggaaggatagataaaaaagaatatgtcctgccaggttgtcggagctaccttatgagtcgtcctcaccacggtcgatgaccctgacatggtcaccccgaaccgtgataggaatcggcagaacactttcatacagctcaacggtaatctcctcttttgaggcgtctacacgcttgactaccgctttttctcccttgaacggaccattgataagttcaacaatcgtcccttcgtcaatgccactgactgccggttttggtatcaggtagtgaccgacttcttccagggtggtaactcctggtaggacagtgcgcgcactgggaacatgttccatcagttcctggaccctggcgatcggctcatcggtctctaccagaacatatcctttcagttcgtcagggacaataactgacataacccggatatcattatccgcgtcccgcaccgccttgtcgatattgtctgcgaccgaccgttctgcccggtttgtggtctttaccgcgaaaatgcgggtaagacggtgttcattctccatacgaatcaggccggaagtactaggaagagttcgtagattgcaaacccgataattccaatcagtacgacacctgccgcagcgacgagtgctatttttgtatactcatcccgtgttggaaagcgggccagtttgaggatacgcatgtatttgcggaaaagttcctcgtttaaattgatgtcaagtttggggatttccatgtatatcacttcagaaaatcaatctcaaagtgtctctgaaatttcgggttatttttttcatttctaccatatatttgtggcgaccgaacgccggtcaggataagcagggtccgtatggtgttctgcatcgttggatctatctgagctccccatattatccgtgcatcagggtcaatcagggcataaacctcttcaacaacaccctcagcttcagccatggtcatatccggccctccggtaacattaactagagcagaggtagcgcaggaaatatcgatatcaagcagaggagatcgtatggctttgcgcaccgaatccgcagatttgtcctgggcatcactctcacccatcccgatcatggcaactcctcctttctccatgatggcccgcacatcggcgaagtcaaggtttaccagaccgggcacggtgataagttcggtgatacctttgaccgcccgcatcaggacctcgtcggctaccttgaatgcggcatagagtggcaatttcggtacaacctcaatgagccggtcattcggaacgacaatgacggtatctgcaacatcacgaagacgttcaagccctgcctcggcattctccatcctgatggccccttcagatgtgaaaggtaaggtgactatggctatagtcagggcaccttcttcatgggctgcccgtgcaaccaccggagcacacccagtaccagttcccccgccaagaccagcggtgataaagaccatgtcagagtcttcaacagcccgtcggatgtcatgttcactctcaagtgctgcctcttccccgacctgcggataggatcctgccccaagacctcgtgtccgctgtcttcctataagaatacggtgatctgccttgacggttgcaagatgcatggcatcggtattgatggcatacagggtggttcctgcaatcccctcatccttcatccgggtaattgtgtttgacccggcacctccacaaccgataactgagatccgggttgtcatcgtccggagaacagcatcaagatcactattattctgcggaatctgttgctctgcttttgccctgttgagcgcttcttcaacgattgatttcatctggcctgcctctgcggaatgtgaatccgcttttctgtctctgtcatcaccatttccggatagataaccgaatcaccaacctcgaccggctttcctgccatcagctcactatagagcgggccagagggtatgcccagatttttggctttcttcggatcaaaccgtaattttttgatgattaaagaatccccctcaaaagaacaggtgtatctgtcctgtaacaatgttacacagagatgtattaattcatccgatattctgccgctgaatgctgcatcggtaataaaaaccggatgacatgcttttcctctcccggtcatatgtacgattggaaatgagtctagcgcagaaatgaactcttctgcagcaactttcataacttcatcgaccagctcacccggaatggtcagggagaccggggcaggcatctccaggatggtatggagaacgattgatgatccgggaatgagtgattctgcaaggtttctgatagacatatattcagagaacgggagatcaaagagccgcatcagatccccctgaccaaggatcgggatggtatgcttgtctgcaagaccggtaatcatccgctcctcttttccagacatggatttcccatcaatatagattgcaaaagcaccggtagaagagatgatatcctgaaataatgcatccgtcaggtgaggaatatcacgggtcggcataatatgaccaaagccgcctctggttaattttgtgatctctgtctgacgctgggcataatgcgtccctccaaatcctgctaatgggatgaccgatgaggtatccatgagaagagcatccagtaccgcttgtgctactgccctggcagcaatccggtcattccattccttctctgtactaccgagctcgataaaacaggagggcagagggatgtctgtcggaccatgatgggtagcctcatacataacttcatacccttccggagcatggatgatcagccggttgataagagcatgcataaggccggttgctgcaggtgtcagggtgtttggacgtcccccgtaatcagcagatccaaaattgccagtgacatggaccgttaaaaccggccgtggccgttcactggcatggcgtgatagaaaaagaatcctatctgcatcatggggcagggaggggccgtcaagatagataagccgttcttctgcatgccagtgtctgatatgggaatgagcccttttgtcatcttctaggaatgaatagagttcttcatgaatgagtgaaccggccgggtctttgcgtgagctgataagtaaggttgttggagactgttcttttggtgtcatgaatggtaattctcaccgttcgctgatcttaaattcagattcctgaattgatcccaattgagtataaacactaatatcaacattcatcagatttaaaatctctcgatgcttttgatttatcccagtaattgtgtaaaaaacctgttcaccataaaatgaaactaacaaataaatctctttgaaaaactcaataattctttcagttttaggattatttactattttcgttggattatattcgaaaagaccactcaaaccctgacctctacttttcagcgaatccctgacttttttctcaataataacaagtggtctcattacaatagtcaaaaacttcactaaaccatcaattctgtcatctcgttgaataaacattggggcaagtgaaagtgcctttcccttcagccgatgaaattgatgctctatgatatactgatcacggtaagtcagaacaacatcttgcatcgataattcattttctggtttatttgttacatataccctccatcctgataattcctgcgcttgttgaagggcttgcaagttaatagttggtttaacctcaattctcgtcgattgttcaattctggcgggattgtttccgtattttcgttttggagtattactaatatgctcgatatactcaacttcgaataccgctgttaatcccttatctccaagaatagcatgtactttttcttttgcttcctcgattgttcggtaaattttctttccctttcctcttttattcattgaatttatctcaaagaaagctttttttacttgctcttcaagtgataatctgaatttatttgcatgagcaaatgattttgcgtagattagccgttcctcccaggttatgattttcccctcatattccattgaatgagatatttttttctcaaatccttcggctataatcgcatcgcttccatcatagtacgatcgtgaaacttgtgtgaaggaaagattagactcctgatgtgctatgattgcagaataaatttcctgagtaggatgagagacttctgataacgggcataaataaaagtcattattgatagtcgtatacaaacgagttgctatggcacccattttgcaatctcccacaaaaagtaatccagattgtcccgtagattttttcaccttttccattgcagggatatagagaggatcatcagcacaatttccagggactacactaacggtgaggggcaaacccagcacatcaagcactgaaagtacgatttttatttgagggagggaggcgtcatcttttgagttgccaaattgtattaatccgtttttatcgataattccattgctgtttactgttgtcatatcaagacggacgatgttttcatccgttaaaccatatatacgcagtgtagaacgatttaattcagattcaaatcggttccaaagttcattattgtgcaatagagataatatacgagccaaatggtcatcagtaaagcattttggactaaattgaaaaccaatcaatttttccagtaaattttttttggtagtaacccacttctccaagggacacatacgatgatcattttcggtcaggcagtagcagatccaaatggcaatcgtttcaccaatcggcaaacccacccagtttctgtgaggcgaatatacctcattcaaaattcgtatgatttgaagttcttttaatgtttcaaagatatatgggattccgccgatgtgttcaatttgatgtgtcggagcgatcatcccatatatatgtacacttctcagatataaagttaagctttataatttaacatttaccttataagatcagcgaaaggtaagtaattattagctataacctttattcacaaatttacaattattatatatggaacctgaaaagataaaatcaatttttgaaactgagggtatcattacagaaattcaatgtccgaaagcctttgagatctctgaaaagtacggcatctcaaagatggatattgcaaaatactgcaacaccaacaatgtaaaaattcgtgcatgtcaacttggctgctttaaatgagtcggtttctttcggtcatccccgtcgataatgcgaggaccattcttttaagtcttgccagaaaaaccaccggtaagactattccccttgcagattcacatggatatgtcctgagtgctgatatcatatcagatatcgatattcccggttttgaccgttctaccgttgacggttatgctgtttgtgccgcagataccattggtgcaggagagagtattccggtcatgctccggttgtcaggcaggatagagatgggtgatgagccatcggggagtgtgtcttctgggatctgtatgtatatcccgaccggggcgtatcttccaccaggtgctgatgccgtggtcatggttgagtactgcgaggagatgggaaatgatgtattcatctcaaaaccggtagcggtcggtgagaacattgttttcagaggtgaggacttttcttcgcagaaaccagctcttcatgcaggcacacgaatctcttcacgggttatgggtgtcctggccgcctgtggggtttcagaagtgccggtatctgaaaaaccacgggttgcgatcatctcaacgggaaatgagatagtccccgtatcagacattcctaaaggcgggcagattcgggatgtgaatacctatctgtgtgcaggatttatagaggaggcgggaggtattccggttcctgtcggaatagtccgcgatgatcggaccgctcttgaagatgcactcatacaggccatcagtcagacagatatggtactcatatcaggaggaagctcaaaaggtgagcgggatatgtgtgcggatatcatcagacaaaaaggtgaactgctggtacatggtatcgctctctcaccaggaaaacctacaataatcggcaaggttcatgaaaaaccggttatcggtctccctggtcatcctgcctcggcctatgttgtcttacatgctctcgtcagggacctgatttattgtatgaccggcgagatttcacatccgatccggatatcaggaatactcacttcttctgttccatcggcaaaaggaagagaagattatatcagggttatgctgaatgaagatgccatagctccggtttttggtaaatcaggacttaccaatacccttaccgcgagtgacggactactctgtattcctgcagatactgaagggtatgaaaaagggatccgtgtttttgcagaaccctggaggagtttatgactgaacgatatctccaattgaaatccttatccgaaggactgaggatgttacaaaaccgtttcccgtttgaggcaggaattaaaaccgtgccggttcaggattcaatcggattggtaactgctcatgctattcatgcatctctctcttaccctgccggtcatctctctgcgatggatggtattgcggtaaagtcaggggatactcacggagctacggatcagaacccacttatcatcaccgattttgtccgggtgaacactggaaatctcatcccatcaggatatgatgccgtcataatgatcgaggatacggaagagaccgatgatggttttcaaatccgtatgcctgcatttccctggcagcatatccgtcccgtcggtgaagatatcgctcttggagagatgattctgccggggggtcataccattcggtcaggagatatcggagcgatggcatcatacgggattagtggtgttgatgttctttcggtcagagttgctctcatcccaaccggaagtgagatagttcccctgggaacgatgccaaaaccagggcaggttattgagagtaatatgctcatggctgctgctgagattttggaaagcggcgcccatgttacattgtatccaatagtcccagatgagcctgaaaaaatcagagatgccatcaccgaagcagtggcttttcatgacctggtcctcatatcagccggctcatcaaaagggacaaaagactacaccagccggatcatcagtgaactgggaactgtttttgtgcacggtcttgcaataaagccagcaaaaccggttatatttggagaaatatcaggtaagccagtcattggaatgccagggtatccggtcgcctgtcataccattcttcgggaaattgtccggccaattctcatatggtatgggctgaatgttccccggtatcagacaattgaagccaggctggcagggccgctctattcggagattggcattgatgaatttgtcctggtaacgacaggaaagatcaaagatacatgggttgctctccctcagagtcgggggtcaggtatccagatgagtcttgtcaggtcgaacggatacatcactattcctgcttcttctgaaggatttgaagcaggttctctggtttcagtgaaggtcacggtacctttgactgaggcagaacagaccattctcattaccggctctcatgatcccgtcattgatcatctgtctgatcttcttagaaccagcggtatattccctgcatccgttcatgtcgggagtatgggaggccttatggcattaaagaggggtgattgtcatctggcccctatgcatctcctctcagatgatggtgattataatatcgcattcctgaagcggtacatgcctgatgaagaattgatccttatctgcattgccgaacgggaacaggggatcgtctccagggatggactgaattttgatgccattactacgcatcggtttataaaccgacagaaaggatcagggacccggatgttgcttgattatatgttaaaagagaaaggaatctcttctgaatccattcagggatataatcgtgaagtaacaacccatcttgccgtctgtcttgctgttatgagcggggatgccgatcttggaatggcagttcattcagcagcaaaagcatataatctgccattcataccgatcggaacagagcggtacgaacttgtcgtgagaaaagagatctttgagtcagattccagggttcaaagccttgtatccctcattcaatctgacgaattcaaatccctcctcttccgcctcggaggatacagaacgaatgaaacaggagcaatcaggaggatttctccgatctgattttataaaaatgttcccgggaccgctgtgttaacatattcatagaggagccgcatagcccgtttgtcctgttctcctccacatcggagaaccagttcaccatgatgacggataaaccgggcaagttcaggatcttcattgagaatgaaccgggtagcatggaccgtggcttcgatgatattattaagaccccggtgaaccggaattggcaggacctgtgtgatattcacatggattggttcaagccttacaaaaagtttatccggtgtagtatgttcaatatgtgcattacagcatatccagttctgaatccctcgaagccggtgaatgattcgattcccgatcagttcctgaatgaaggattcttctgagagatcttcaaaggctgttttcacgaaaagaatcggatcatgggatatatgggcaacaatccatccattccgtataatattttgcgcggtatgactggtccggaatactatcattgagagtgaatcattcttcctgataatgcccatgggggcagcattattataggttgtaacgatcacctcattgattccttcagtgaatatctggtctaccggatctgttaatggtcccactcccatccttctcctaaggctacataaagcccggatatcatgatatctgccaatgaaccggggttgtaaccgttatccagacagaattcatccagctgtgcagaacgtatcttccctgccaatacctgtgcagccttctctctgacaagttctgatgcactgactccgaactttttcgcgatgaaggtgtccggaaattctgataatagttttagaaatacctttgatataggatttatctcgttctgatgagtaataagcaggtcggcagtataccgggtaagaggaaatccctgggttatttcacgggcgataagatcatgaggtgcagaatattccatgacatcaaaaaatgtcatcttccgctttatgagttcttcttttgccttcgggtcattgatgtcaagttcatcctcgtccctgaccctgactgctgtatgggtaaaggcatcataaaaatccagggcatcctcgatggtcgtctgtcttacaatttctgatgcttcctttatggtgtcacccatgatcagggggatgagcaatataaaagccccgaaatgggtattaccacctttatgtcgtcctgtcaggatagtcgcttccctgataagagcaccaacagagcccttcctttgttcagccttttccagggccgatctacagaagatgacggatgccagaaaatgctcaagttttgtgtcaggatagtcatgacaccggtctacattccctggcttgtcccaggcgcagacttcaaaagccatagccatctgcgcccgttccgttctgctgattataggcctcatttgaagatttttttcagtaattttttagagatctctcttttcagatccatgtaggtggattttttaattcccgcctgtctgagtgccgcatccctgaacatacacggcgtggtgtctttacagcaatatacaagactgccaaagcaggtattggctccctgctccagaggggtccctgcgacggcttccatcttcatggtaacgaactcctgcggactgatattataatgctggagtttggggaggagaggacagggtttgaccggcatacagcaaaatgcaagcgatctgatatctcctccccggcagagctgctttggtgcattataccacccatgttcctttgtgtactgtgctatctgcgcatacagggtcgagagggtctttttatcagatttccgggcaagagagatcatatcagcaccatgcgcaaacatctcttttgctttttcaaaggtagtaataccattattggctatgatgaaaatcggagatgtatcgcggatttttttcaggtgggtgtgatcaaagtccatgagatcaatatggaggatatcagcaccggctttccagagcagacgggacaattcaacatcatcggcagctattcctgcgcgaatctttactgataccagcacccccgcaatttttaatgcctgaacgtaggatatcagaacttctggatgatgaagaagaaattctccgcttcgtgcatctatcatcggctgctgtctgcaatgagcatcaatctcatagatgactgaattcccgagttcctgcgcaagggcattcagagaaccggcttctgatgcccgcagattaataaccggaacaacaccggctgccttgatgagcgctatctggcccttcaaatcatcgacgagatttctcggtaaaaattcctcccttcccagatcagagaggacacgtgctgcttttatagtaggttcatcaattgcatatccgccgataatgccaagcccgatatgatccgcaagattacgaatatatgcaccatcagtaatgcctgccatacaggctaccgcgattggtgtctttaccggtttatcaccgataaaaagatcgaaatttgtatccattataatccttgtccataaccatcgatcgttcttatgtataaggttctctgcatgtttctggaaataggtatgaaagctattttaggttaacctctctcatatgatctatttgatacatattacgatagaatataacatttgataactattttattacgtgcagtactacctactgagaatgacaaagactggtatcctccttgtaggacatggaagtaaaaaggaatacaacaagaatctcatcaccaaaactgcggaaataatcgctcagaagaatccggattatatcgttcgatgtggatttatggagtttaatgagccgactattcgcgaatcacttgattcgttcaaacaagatgaagtggacagtattgcggttgttccactcttccttgcccgtggtgttcatattgatgaggatattcccggaattctcggtcttgcacccggtcagaagaagggcctgttctctcttacaggaaaagaagtccctcttgtctatgcagatccgattggacccaacccgctcctggcagatcttatgatggagaatgccaaagcggctcttgacctgatctgatgcggattctcgttctcgattcgattcatggcggaaaggtgatagtagatcacctatcagcccatggtcatgtgactgatctcatcgatgtgtaccggaaccaggaaggcatttctcccgacctggcacgaacccgggtttatgatcttatcattgctcctgttcatctggatcctgattattcactccttcaggacctccggattcctgtaatatcacatcatgcagctgtcagatggcttttcacagatcacgcagtatcttcggttattgagattaccggaaaacaaggtaaatctactacagcagcggcactcgcatctatcatgccaggagaagggctgctccatacatccgcaggagttgtcaggtatccatcattggaacatctggggcgatattctatcacccctgcgtcaatattgcaggtcttatctgaacaattttctgatggctggcttatcagtgaagtatcgttaggattttgtgggattggaactcttggtatcctgacctcctttctagattatccggttgcacaaggaaagagaagggcccttgcactgaaaactgaacaggcccacctggtaaaacaggttctgattccaccgggaggagaacttgtccatgacggatgtattcccgtatctgaccttgtatctgtatccggaaccagggcttgctaccggtatggagatttgtcaggttcatttgtaaatccgcttctcctcctgccaggatacaaaacccctcttatgctcgctgcaggggcagccctgcttcttggagtggatcccgccggtttgtcagatttttcagctcttccaggacgcatggaggtcacgaaagatactggttacaccattatcgataatgcaaacagcgggacgtgtcattcaacaacgcttgatgcataccgttatggcagagagatagcgaaaaatgaaccggtaaccctcatcattggtcaggagtcagcatcggtatgtgaaaacttcagcactcatgagatctgtgcatccatctctgatattaatccccgggatgttatcctcattcccggagatgaacggattatgaaggaggagatcatacagtactgtgcgaataccgggattacctgcatctgtgctaattcaactgaagaaggaattagaagagcgaaaacactgaataatactctaattttattgtctgtaaaacggtggaaataatgaaatatgtacaacccaggcccagttctattgtcgctgccctctatactgcccgtgacctggaagttgatgtggctgtcctccatggcccctccggatgctcttttaagcatgcacggcttttggaagaggatggtatgcgggtattgacgacatctcttgccgagaatgagtttgtctttggtggacagggacgacttgaggatgttattctctatgcagaagagaaatttgccccgaaacgaatggcggtcatgggaacctgtgtctcgatgattatcggtgaagatctgcaggctgcgattgataactccggtgtcagtaccgagacgatagccgtagatattcatgccggatttaccgagaatattgacggagtcattgcaacgttaaaacctgcagccgagattggatggatctctttagacgaactggtacgccagcaggaattattgaaggcagccaatcaggtggaacgacttcggggagctgcagtcagagagtacatcgaaccatcacggggagatctgaagcataaggttgcagaacgtcttgtagatattatccaggagggtaaaaaaggcgttgccatcatgaatgcaaagaaggagactgcatacatgtttgctgatggtcttactgctctccatgagcttgcacctgatgctcctattgtctattctgtaaatcttgagatgcgggggcttccaaaggtcagacgggatgcagagcgtatcattgctgaccttgatgcaacaggtctttcgtatgtgaaacaaggggcacttgacgaatatggagcgaccggggatatgctgggccggtggatacaggatgagaatcctgattttgcattcattaccggtgtacctcatgcgatcccccgagaatacaccgatgggatcgagtgtttttcagtgacaaacggtccccgccaggttgcaccactcaaggatctgggacatgaacatgtggtcgttgagatcgatctccatccacgaactctcggtgtcagaagtattgtggaatccgaatttggggccgtcatccggagttttctatgaaggcgttcctgatttccggtgaccggtcgggatcaggaaaaaccagtataaccctcgcaatagcagcagctcttgcaaaacgatgcaccgttcagaccttcaaagtcgggatggactatatcgatccttcttacctgaccggggttaccgggcggccctgcaggaatctagactcatttgtgatgaaccgggatgagatgactgccgtatttaaccatgcctgtattggtgcagatattgcaataattgaaggggtcaggggcctgtatgaaggggccgatagtattgctgatatcggcagcacggcatcgattgcaaaacactttcacgtaccgataattttggtgatagatgcccggagtattacccggagtgcggcagcccttctgtatggattcatgaaattcgaccctgatattcagattgccggtgttattcttaacaatgtcaggggagagaagcatatcagaaaggccacggaggcaatccggcattattgtagtatcccggtgatcggggcagttcctcgggtcgataacctggacctgaccatgcggcatctgggtcttgttccgtttgaggagggtctgaaggatcagccttttcttgaccgggtctcatccatcgttgagatgatatgcagtcacctggatattgatgccctgctctccctctcacgtgagatgaaaagttctcttcatattcctgacctgtttgcatcagttgagcagcaccaccgcgaaaggattgcagttgcacgggatgaggcattcaatttttattatgcagatctcttttcactcatcgaagcacgaggatatgatattgtatatttctcaccgattcatggagatcttcctgatgcagacgggtatatacttggtggagggtatccggagtactatggtcgagaacttgctgataaccagtccatgatggaggatattcgaacagcagccggagatgagaggcccatattagccgaatgcggaggtcttatgtatttatgcagggagatagatgttcttcacgatttctcaggactttctgccggaacatcattcaaaatggcagatgtgcttccagcccggtgtaccattccaaaaaaacgggttgtcacctatgtctccggaaagactacaccaaattttcctttcgcagaaaaacctctcccggtaaaaggtcatgcctttcattattccacggttcatccggataagggatcaacattcgggtatgaactggatcgtgggtttgggattgatgcaacccatgacgggatggtgctcaacaaggtagtcggatcctatacacacatccatccggtcccgtcccgtgacctgctctattcatttttgtccgcttgtctgtctgactcatccatataattggtcagattgttcttttttctcctttgcaccaggtccgacaggttgatcctttatgagaagtcgagtcagatactttggtatgcagatatatatcgatgggaaattctatcccaaagaggaggctaaggtatcagtttttgatcatgggtttctctatggtgatggtgtttttgaaggaatcagagcatattccggaagaatcttccgactagaggaacaccttgaccgcctgtatgattctgcaaaaaccatcgatcttgctgttccgatatcgaaggaggagatgactgctgcaatcatcgagacctgcaaaaagaataatctgaccaatgcatatatccgaccgattgtaagccgtggtgtcggagacctggggcttgatccccggaaatgcccaaaggccagtgttgttatcatggctgttgagtggggagccatgtatggcgatctttatgagaagggtctgaaagccgttacggtatcagtcaggagaaatccagctgaagctcttccaccaaatgtcaagagtcttaattacctgaacaatattcttgccaagattgaggctaactgcaagggcggagacgaggcaatattttttgacacaaacgggtatgtatcagaaggatccggggataatatctttgttatcaaaaacggagtcattatcaccccaccgactttgaataacctacggggtatcacccggatggtagccctggagattgcaacctcacttggtattacggtgcacgagcgcaatatgggatattatgatctctactgtgcagatgaggtctttgtaactggaactgcagccgaagttgccccgataacctggattgatggacggacaatcggcaacggtaaaccaggtcccatcacgcgtcaatgcatggagcagttcaaaatagtagtacagaaggaaggaacacctatcgtataggtaaaacgatcataatatttttaaggacaaacgtagacatctaatggcacagctgatatagtgtagtccggccaatcatgtcggcctttcacgccgacgactggggttcgaatccccatatcagcataaactttttattttgttaatttttacaataatcttttgatatcgtattttctctattcatcctggcggaattctctggtcaatatgtcaatctcttatcatttgagatcataatggtagatcctgattgcatgatattattatctgaaaaaccaatcagaaaatcatgacctctcctgataatgttccgctgatcattccaatctcactcggttttgtgaatgcgtacattgtaaaacaagatggaattattcttattgacacgggaattccgggtagtgaacagaaaattctggatacattacgagaccacggatgcaaacctagggatatttctctgatcattatcactcacgggcatcaggaccatgctggatctgcagcatctcttcatgggttatccggagcaccggtggcttgtcatgctgatgatgcaggttttcttgaaaaaggaaaacagaatacattaaaaccctgttctataacgggatatttcctccaattcattttcaaccggaaaaaactgtcagagtatcctccggttcatccggatattctcattgattctccatttgatcttgaatcctatggtatttctggaattattattccaacaccaggtcacacgaaaggttctgtttcagtagctctgaattccggggagaggtttacgggggatcttatcttcccgaagatcccatccgggaagcccggtttccccttctgggctgaagagccagatcttgtactggatagtattcggaaaatatgcgatgaaaattgttcagtgatttatacgggacatggaggaccctatagtaaaggggatgttttggagatggtgagaggggtgagtgcagaataacaaattaaggggtttggttttctcgggaatcaatatctgacaagtgaccacgatatcaaatacccatgatttttcccaatctgatagacaaagttatcatcatacagaaaagaattatatttatactttcattttaactttaaaaataaagtcggtgaattattgttatttattgaaatatcgtaaggaggtggagatatgcctgatgatcttatggagattatagatgaatcaggggaagtaaatagcgatcttatctcaaaggtccgtcttgaattattctggtcattatcagatctcggcgatgacggggcaaccgcacgtcagctgaaatccgctctaaatctgaatgatggagccatatattcaaatttaaagaaacttgaaatacttggatatttaaaatgtgaattggttctttttgagggaaaagaactggaactctggtcaatgactcttgagggattagaagaatggaagaaagtgaaaaaatggctgtgccggttgctggaatgttcaggtgattcttgtggcggatattgaaaaagctattgcatgtttaaaagctcttgatttttatttcgacatcagtcaatttgagcaccggctcattgttcaaaaagtaatctttctcctccagttaaaagggtttcaccttggatatccctatggtttgtatgtcagaggtccgtattctccttcattggcatcagattactatcatcagaaagaagaattcaaatctctgataaccgggaaagatcttactggtgaagaacatcagatcattcagaatctggataaaatctttaataaaaaagcttcatatttagaaattggcgggacatatgggtacttcgcttatgttctctcatatgatcccctgaaagccatgaagatggtaaaaaagatgaaatcccagtattctgactcacaaatagcaatagggatctcaaaagcgaaagaatttctttatcccccgactgaagaagagaaacaacttctggagaatgaaactgcaccctggaaagcggtcgccctgaacactcttctgagtgattgatgagatctgcgagaggcgagatctggataattgatctgactgattccagggggcatgaacagggtggaaagaggccggtgattgttatggcatcagtcattggaatgaatattgtaatcccgttgaccactcagataaaagttctgaattaccctcatacctatcttatcgaaccgacatcatcgaacggtctttcggcgccaagtatagcaatgacatttcagatagtcgccattgatgagaaaagacttgagaaaacgattggtaagatctcccatgcagataatgagattgtaaaggctcttctcatagatctcctgggtttatacaaataagcatgaaaatcacattccagaaaaaaattccccatttctagagacaatcgataattatttactcttctctctgattttatttttttgaataccttcatttttttcatcttttggtggtaaatataagtcttaatcacgattatctacaatcactcatgttcaatcacaggaatttttatcccatacatatcccactctaactcctaaacggattatacttataccccataccacatccccccatactctaccatcaacatattataaaactaaaaatggaaggctattgcgaagaaataataaattttctcctcgatgcaacatttgtcattgacctggacggtaaagtcattgcctggaaccgtgccatggaggatgtcaccggagttactgcctctgacatccttggaaaaggtgactatgcctatgcccttccgttttacaacgaacgaaaaccgatgcttgccaatctcatcctccttccggatgaagaggtagcaaaacggtataaccatatcatccgtgatggtgacacccttgttgttgatacatttcttccgttatcaggaagggaaagccggtttgtgtgggcgaaagcaagtcctctgtatgatctgaatggcaccatcacgggatctattgagaccatcagggatattaccgaccaaaggaagatggaagagatacttgccagatcgtaggctgaacttgacatcgccgctgaaatacggcgaagtttcctccctgacacaattccttccattgagggctttgacgttgcagcgacctgtgtgatggcaaaagaagtcggaggagatttttttgatgtcatcccaatggaacttgttcctcttcatcagggaagctatgggattctcatcgctgatgtatccgggaaaggaattccggcggccctgttcatggcattgtcccggattgtagtcagagtgaatgcaacctggcatcatgaaccggcaaaagctattgcatctgcaaatacgataatcgcccaggattcaaagtcagggatgtttgtaaccctgttttatggtatcctctctgaagaggaccggacccttacgtatgtcaatgccggacataatccccccatggtgtaccgggcaggaagtgatacctttgaagagttaaccatgaccggattagcaatcggtgttcttgaggatgaaatttacggtcagagaactatccccatagagcccggtgatatcatcgtcctgtataccgatggagtcacggaatcactgagttcgtcacaagaaatgtttggtgaagaacgtctgaaatcaattatatgggagaacagatccctgactgcaaccggcattcagaagaaaatattcgatgaggtccagaattttagcaaatcagaaccacaatttgatgatattactcttcatgatcaagggtataccctgattttcctctcattatgtaccttgaatatatgattcaactctcatgaatcctctgaaggaaaatgggtggatttattttttccagtacatgattgtcataataagagagagcatcccagaaataataaagaatattccgaggatcatgatgataagagctgttcctgcacctggatttgtaaacaggtaaataccaataagtaaactgataacacctgcgataccggtgaggatgcgatgtttttcccaggtgattgaaatggcatatgcaatagtcagcagaccattcagggtaagccataatgcaatcaggtacccaattgcaatggttgcgacatagggagagatgatagccagtagcccaataagaatactcacgagacctgatcccagaagtatcatctttggcgtcccaccctctgctgatagtgccacgccagcggtcagaattccaaatatcaggaatattactccaacaatgagaacaaggaagtcaaatactgccgatggagcggtgacggcaactatgccgaataaaagaaccacgatgctcaagatgattgcgaggatcttttcagtgtccatatgtatgataaaatgcggattaggtataaaaaggatttgtttaggagtgaagtgacaccgacccctgtaatcggtttgtctcacctgatctccagataaaccagattaccgtatcccggattctctatcacagacctggttatatagaattcaggagcatgagtgacacatcattactcatgagtactaatgtaatatcaaggatccgaatatatggaacataacctcataattgctaatgaaataattatcatcgctcttctcctggtcgcaatcatcgcttcaatgacattgcggcacctgaagatgccctataccatcggattggttctcatcggatatgccttctccgaatttatcgttcctcatatagatgcattaaaaccgattggaccctatttcccggcggtggatatcatcctctatatatttcttccaccgttgatctttgaatctgccattgcggtaaatacccggctgctcaatcgaaacctgtttccggtattatgccttgccatattcggggtcatcatctccgcaggaattatcgggtacatgatcgcatggtattttgcaatcccgcttctctttgctcttctgtttggtgcattgatatcatccaccgatccagttgcagtcatctccatctttaaagaagtgggtgttccgaaacgattgcagatccttgttgaaggagagagtctcctcaatgatgcctgttccatcataatgttccagctggtgttacttctcattagtcatccgcttctgaaaaatgatctgtcattttttgaaacatcagctctctttacctcccagttactcacatcatttgtcggcggggtcttcattggagtcattggtggtctcatccttcgagtaatacttaggaaaactccccttcactctcatattcatcagacagcaacgttggttgcagcatatctgacatacctgctcggtgatgaaatgggattttcaggagtcattgcagtcgtctcatgtggatttatcaccgcacgggcagtatcagactggataggaccggatcggcgtgaagaactgaatcatttctgggagtatatcggattccttgcaaatagtctgatcttccttcttgtcggtattaccatttcatcattacaagatctctcccttctcatcaaaggagggattttgggagtttttttcctcattggtgcagtattacttgcacgctttgtcccgatagtaggaacctttgccatatttaaccggtttaccagacacaaggttcctttttcataccagattgtttgtttctggggaggccttcgtggtgcggtggcgatagccctggttctctctctcccgctttccctgccatttcgtgatctgatcattgcattctcagttctcacggttctgttcagtatctttgtccagggtatgactatcggcccactcattcagtatctggagctcggacaatcacggcttctgcgaacatttcaccaggtatatggagatctagtcacttccagggcagcacagtccagtcttttaaagtcagacctggcagggatcattgattctgccattcttgatgaatatatccgaacgtatcgtgaaaaatcccagtataccgaacagaaggttcgtgagttctggcaggaagtgcaccagacacctgaccggatgagtgttatcaggcttttctggctagaagcaattcattatgagcagaagcaataccgccagctctatgatgacggactcattcattctccggtatatgccgagctgcagtaccagactaccatccgcgaggattttattcagtcagggaattatcatccaccgatccgtctctatgcaccagagtccaggtacgggttatggctttaccggtttatcagacgaattttcccgaatagtgctatgctgaattcatatcagaaccggatagatatccatctgatctttgcttcagtagcggtttatgttgcatcatctgcaacaattgagtatcttgaaagactttcacaatgggtctgtcttgattctgctgaaataacagatattgttgatttctataagaaatttgagcagaaagctctctcatatcttacatcagagcatgtcgtcggttcacaaaacctttcatacgtgagtgggtacctggcagaacggactgcaggagcaggaatgatccatatgctgggtcatcacattgaagaaggaatcggagacgaaaaaacccttgggcacataattgaccgactcattaaggagaagaacaaggcaaagaaaaaggtgtttcagttatgtggcgatcagatagtgccataaaccaaaattttgcaaatcctttcggaattagcatggaagggtctttctcgataaagtacaatcgggaggtggcataactgataattactcggtaaatccatgtaccaatctgactgtcctgaagatcagttatgtactggatattgataggatatggatgattggggcaggatagagtacatagagccttgtggatgttttatgaaaattattccgtaaaaaagagtaggttaaattttaaatttattcatttcttgcgagattttctgcaaggaagatgaggcatcagatattgatcgtgacacatgatcaatggatgcacttatctcttcggttgcagcagatgatgaaattgcttcctgtgatgtatcttttgcaagtaattcaagttcatgaacactcgctgttatctcttcaacacttgcagcctgttcctgtgtgttcgcagcaacatcactgactcgttttgatgctatctcaattgaatcagcaatatgttcaaagatagtcatcatctcttgtacagccgcatcaccggttgttacatcctccagagaacggttcatggaggttgttacattctttgactttttctggagaatggctataagttctgcaatccgttctgctgacactcttgattcttctgcaagggcttttacttcatttgcaacaacagcaaacccaagaccagcatctcctgccctcgcggcctcaattgctgcattcaatgcaaggagatttgtctggtctgcaataccactgataagttcaacaatagaacctatctcacccatctgttcgtcaatttcctgaaccacctgatttgtcgcttcaaaggactccttgatattcttcattccctctccggttttttgaaccaattttgttccttccatcgagagattattggttttctgtgtaagtcctgcaacatctgttgtctctgtcgcaacagatgataccgccgctgcaaggtcattcatagcacttaatatctgttctataccgtgggaggatttttctgagaggtcgctgacctgattggcatttaatgcaagggttcttgatccggcagcaatctcctccgaactggcatttgtttcctcaatagtaccaagaagtgattcaacctcctgtcttacatgcagtatggatgagccggtatctgttccaatagtgttcagggcatctttaaagggaataaaatcccctttcacaataatttcttcagaaaatctggctgtaaaattacctctggcatattctttggaaagggccatagcctcatttatgggaacaagcagattctcgagagttgcattaaatcctttgatgatatctctatatgcacccttgaataatgtttcatcgcccctgatcgataggttgccatcctttgctgctgaaaccattttttcagtctcatcaatcagattactaattgtatcagcggtaacacggagagcaggccctatctcatctttatcatccacaattgggatatgggatatcttctcaccctgggcaatcttctgcatcgacccgataacatccttttgaagattatttgcaaaagaatccattgtttctgccatttgaccgatctcatctttcctgatcatatcaagccgcattcccagatggcctttattcatctcctgaatcatggtgacagcccgtgaaagcggactggtaatacttctggtcagaagtaaggcaagaccgattccaaaaatcagagtcagcagaacaataacaaaaaacaagagtgacgattcctggtaggttcgaacgatatcatctctcattaattttgatttttcctggttataaatttccagattatcaagagcatcctgggctgcatctctgggaacagaaaaatttttactatatatcccttctaatgccgcttcttcccttccattattcatatcatcaataattttccgaaggttagtttcaaataccggccagtttctctcaaattcttcgatgagtgctgactcttccaaagatagtgactgacttttatacgcttcgattttacttttaatatttataatttcatcatcaatctctgcaaatttatcttttcgttcatcttttgcaaatactgttttgtagatgttaattctgatattgagaaaactattatcggcatttaataattgctctaatgaaacgaggttatcatcatacattgttttcgcctgttctgtcatatcacccattgccatgtaccctaccaaggcaatgaggatagccaataaaatgacacataaaaatcctccaatcagtttctttttcattggaatgttatcaagaaacatacagtaccccctgtcgatgtgtaattactacctatccctggatagtaaatagattatggttgcctataattaaggtaatactaagataatttaagaggttgttgcacaactaaaatgtcgtttcctcaagagtacaatttccattcggttggaacgttaattggcaatgaaacagacatgaaccgcttcgcggttcacacccgaaaccatgaaaatctcatcggttgaccgatcatagtgggtaataagactggttaatttctgaaactttgatctcggttaagaaagtagtcctttttcgtacaccagaatgcgacatagatcgcgaatgggaaattggtgtaacgaatttactacccacagggtaatttatgtctaaaaaacggaataaagtttgtggaattgatgttcacaaaaggtttcttgttgcctctatcctggacaatgaaggcaattgtgaaactaaacgttttgaacaggatttggacgaattaattttgctcaaaaattggattcttgattcgggttgtgaatcggtagctatggaatctactgctgaatattggcgtcccgcttatggtattcttaatccagagatcaatatcaccattggaaatgcttaccatatgaagggcatcccgggtaaaaagacagatgtgttagattctcaatggatcgccgaattggaattaaataatcttatcacgccgtcacgagtttttacgggtgatctttacgaacttcggacattgacccgagcccgaaataagatggttaataatagtacagtttttaaaaacaaaatcctccaccagtaagatgtttgcagtattcgtttatgtactgttttaaaagatgtatttggtaaaagtggatatgctcttttaaaagggattgttgaaagaaaaactcaggatgagatcataaaagcattacccgccaaaacaagaaagattgcacctgtcttttttgagcagattccagagtatatacctgattcagctatattcctcatagattcgatgttaaaaatatatgacaacctccaggttgagattaaaaggatcgaggaaagaatcaaattttacctcaaggataaagagaatgaattacgtattttaatgtcagttccagggattggaatagtaattggatctaatttgttggcagaaataggtgatatccatgattttccaaccgcagataaattagccaaatgggcaggacttaccccatctgtttaccagtctgcaaatatcaattacactggacccatcacgaaacatggttccaaatatcttcgatgggctcttattaaagctgcacactctgcgattagaagaccagggaaattgaatgactatttcaacggtctcttacctagaaagggttacaaaaaagcaattgttgctgttgctcgtaagattttacggattgtttggcatcttctcatcaataatgaaatatttgaagatggaattcctagagtgaaaactgttaagattcccaagtttccagaaaaaattgagagagttggaatcgcaaagattattcagcttttgtccaggggagctgagataattattcaagaggaaggtaaggagattatgcgaattaatggttcaagtcaacctatttgataccgattttcatgggaaatgcaatccccggagagtggtgtaattatttttgccaatcattccggatacctgaatctggtattcaaccgactggtatgagactctttatcgtgtatatgggtcaatatctcagccattcatgataaaaccgacagagcgatcttctcttcgccttcatcacatcgtagcgctctatgttggttcagttctgggatgtggtgtcctaattcttcccggtctttcagcagagattgccgggccgggatctctcctctcctggattttcatcatcgttcttgcgtttcccatggcactcaccatgggttttctctccgcccggtttccaaatgacggcggggtttcatatttcgtaactcttgcgttcaatgaacagctcggagcactcatcggatggttcttcctggtatcaggaatcattggtgttccaatccttgcattaaccggagccggatatattgctgctgcatatgggctttcggaagttttcagaatccttattgcagtctcaattattctggcaggaatttttctcaattacatcggtatgcgggtcagcagtcaggtgcagatcattgtcgtccttgggaccatctgcattctgcttggtgcatgtatcgggagttaccggatcgttgacccgtcacatttcacccctttaattccacacggatggatgagtatcgggtatgcagcaaccttactcttctggagttatatcggatgggaagccgtgactcatattgccgaagagtttgaggacccaaagcgggatgtagtcaggggcacgattatcgcctcaatcatcatcggaagtctgtatcttctcaccgcatatgtcgtcgttggaacccatatgtatggaccaggaatatcggatgtttcgctcgtgtatctgatcgagaaatcatttgggcagtctggcatgatcctgaccggaatgaccgggttatttgtctgtctggcaccgtccatatcctacatcggggcagcctcccggctttcatattccctagccgtgaccggctatgcaccgtcatttcttgcacggttatcagagcggtattacacccacatcggggggcttatctttttggccggatgcttttcaatagtatttatcatgtacagcaccggtctgctctctcttgcatttcttattcaactcccgaattccacgtttatcctaacctatattggtggatgtgcagccgggttggttttactcaaagatagccggtgtgcattatttatgagtgggatttcgctcattttaacatcatgtatcctgctttttatatcttgggcgatattatttcccattggtattatcctcatctggggtattttcttgatgagaaggagaaaaaaaatgggtaacctgctgaaaagcatgtgattatcgataattttttggtacttttatagataaaatcacgaatttcagatattcaatgaaataatctgattcacctgttttatccacattctgaaaaccggtggggactgattcagtatccatactgtactattcattctattcctaaaaaataccctgataatcatacctgctccattcaaaccttaccccatgggaaagtgcggtcacctataccaatccggagcacacatgtatgagtagcactatgatcccggaaaagatacccatcggcaggttttcaatgattacccgcctgacctgcaaagcacttcgtctctatgatgaaactggtctcttatccccggcggtgaaggaccggtttaccggataccggtattaccaggtatcacagattgaacgtggtgtcatgatccgctctctcgtagatcttggattccctcttgcacagataatcgaagtcctgaaagccaaggaacagggagatgacagtactgtggcacagctcattcaggagcaacgaaagcgggtatctgccgagatcaaacggttacaatccattgatcactttctgcaaagacagcagatggagatgttttctatgattgtagcagaaccaaccttgaaagatatcgaatcgctcagagtgctttctatccgtgataagggaacatatgaagaggttatcccgaaacttattggcacattgtgtcaatatttctcttctccccagagagggttagaacaggtatccataaccggcccattcatgacgatctatcatgatggtgaataccgggaatctgatgcagatgtagaagtggccgttccggtgaccgggagattgcctgatcagattccgggtattaccatacgaacgatgcctggcggccggtttgcatcagcaatacacaagggaccatatcaggatgctcatgaatcatggggaaaactctatgaatggacagcgaaacagggatatgaaccgaaggccccatgtcgtgataattacctgaatgatccggatgacgtgcctgaagaggaattactgactgaattactcattccggtttgatgaattcgatgtttcttaggaaaccgggagggaaacaactcttcttttcctggtatccgaagtgcagcccagtactcctcaataaaatcattatcaacgaggagatcgatatatcccatcctttctgcaatctcggttgcttcccgccgtgcatctatggaaagaagacaggcatatgctcctgcaagagaaccattacctatccggtgaaattttgcagacggaaattctggaaggattccaaatgatatcaggtgatcaatgtttccaaaagagccaaatgctccggcaaggaatacatgctgaatatcatgaaggcgtaaccggtatttttgtaagaggaccgttatcgctgcaaggacagcggctttcgagtccatgagataggccatatcctcactcgtgatgacaatatcttttccggtagcagttttcagagcaggaaccagtaaaaattcaggtccattctcaccctgtctgacacccggtgcagtatcgacgaacttcccgctaaagtccagaatgccggcacgagccatttctgcagcgacatcgatgatacctgaaccacaaatccccttgggctctgtatcaccaatgacatgaatggtgacatggccgtcaaggccgattttgacggtgtctattgcccctctcatcgcccgcatccctgatcgcatccctgcaccctcaaaagccgggcctgaagcacatgatgtggaaaccagccagtccttgttcccaaggataatctcaccatttgtccccagatcgatgagcagagagatctccatttttttgtgtatgcctgcagtcagaacatcgccaatggcatcaccaccgacaaatctgctcaccgcaggaaggcagtataccagcacatcaggcccggtagcaattccacagtcttttgcagtcagaataatcggatcggttgggatatgtgcatccacatattcaaggggagttggatctcttccggcaaataaccaggacatcacggtattcccgccgatacagatgtcattgatctcactatccataatcccggcatccctggtcagcttgtggatgacctcattgatacttccaagagctgccgcccggagttctgcccttccatcttcttttcttccgatggctattctggtaaccagttcttctcccagggttatctgtcggttcagggttgaggcccgtctgataacctctccggtgatgagatcgatgagaagaccgacgacggtggtggtccctagatcaagggcaataccgaataaactcccggttgtatctccttcttcaaggctgatgagcctgcttgttcctccatccagagagataactccggtaagagggccattagcatgcagaatgacctgtctctgttcctcagtcattaccggccttttcccggtataaccggtaaacctgatagaaggtcccaagattgccgttggtccggtagtgtttttctcaacctgatacttatgcacagaggggtggattgtcccgattgtccgggcaacgtctagaagaatctggggggtgtcaattctgctctcaatgggaatggtgaaaacggcatcggtccagaccctcacaagacatgccaggcagtatccttttcgctgttcatcaagggtgaggaattttgcacagacggagccctcttcagatacctttcccgataccctgattacccggcattttccacaggttccctttcccccgcagattgcttcaaactgaatcccagcttcccggattgcatcaagaaccgttaagccggcctcgacggtcaccatccggttcatcggctgaaaaagaatagatattaaatctgacacgattattcatccgcaggaggccagcattcccgtatcatctgcccgattcctgatgaatcacgtgggccgacaagaacacgccatccggtctcttcctcggtctctccggataatcgggcagcaagaccggggatgataagattcttgtgagagacaagtgtatctgccttccattctttgagagattcggcaatttttgctgcggttagatatcgtccggcgactgctgcttcgacagaaagacctccggtatcgatgacaataaggtagcagtctatctttgcagccttgatgtcagactccacagtaaagaaggtcagggcataatttgaggtgatgagaaccggagacgtcttatccggattgccaaaagttctgacacctgcatcaacagataccggttttcgtgggtcggtgtagataccaaaccgccagataagctggggaagaagagcccatccctcaatgctgtgcataatcaggagatcagcataccgggtgatgagcatggatgtaagatatgcctcctgccagtggttcagatcatcggataattccggtccgttccataccgatataggggttcccagaatcggatacccggacagggagtcgaaatttttcacagccgcttttcggagagcagtaaagagatgaatcgtctgccctatctggtcgctatggaatgttccaggatccagaaccatatctacgatgccccattcctgaagtgttctgaccagagttctgagaagggatagatctcccggagctgataccacaaccggacagccggtatccagaaccagttcacccatctctttccagttctctttcgtgatggcaaatatgagcggttttctctctgcacaagcggacaatcctgcttttatgatattcgggtcagtgctgcagagaataaggggaaggttacaaagctcacagatgtgctgaataacctctgtatatcgatatgggttttgggttactgaccgtacggccagggcatcaagggagagtggtcttccgatataggtatatgagaaatcctgcacctttttaattctgatagcaatctgctcattctccatatcgtcagagatatcgatggcgatggggggcgggttctggtaggtgaattcatgcctgtacaggacatgttttccgccgatcttcagctggttatttccggttccaaaatggattacacgaaccggcggggcgagtaactcctgaagtttgagcaggtctttctcataattttttgtcagaacaggggggcatccttctataaacgcctcaccattcaccactttggttgcaaaagccatgcagttagcttcgccacattctgcacaatttgtccgtggcaggagtttatatacgtcaatcggactgatctcccgaatactttttttatgttcctctttcatcctgtccacctcatatcttcagtgctgcccagtcagccatatccggttttatctctgccgggtgcatgagttttccagctacgtcacggagcgttgatacggccagtggatgcatcatcaaaaagagatccacaccggcgagaagcagggttattccaccgattgtttcccataatggcccccggagatcattcctcccaaatgcaggacccagatccatccatgcttcacgggctgaccatgcattcgtgcaggctgatattgtcggatgctgaagctccggatcacccatgagtgcagccattcgtgcacgttcatggattgaaaacgagtattctagaccatatcccaaggcaaccgttgtcaggtccataagaagtcgttcgggagggaaatactggtatatacgtcggttcagttcctttgcactattcaggtcaagaccggtgaacccaagaagacaatggccatgggtatccgctgctttgcacaccggttctagtgtcttggcatctgccatgtcagaggtgactgaatttaaaagcagacgttctccttctgccattgctgctatctcagtaaaggtctccgcatcctttttgggatcgccgcatccgcctatgataagaggaacgtccacagcctgcaggacttcctcaaccgtcttcgaagcttctttaggagatttattctgaataagtggatcggttgagagcagatgaaccgttaccatatcagctccgaactgctctacattcatctttgcccatgctgcaggatcatctattacctcggtcagatggtttttcaaagcctttggcatcgggacacgggtgtcaaacacatcaagggatatgaccggaggatgaggtggcggtgactggggatgcgtgaatggaatggaggttgatcccccgacggtgatagtactgccccgtgttcctccttcagcccgggtggcaccaagagtaatctccctgatttgtgcggggaatacatccggttccatcaggaatttttctgaaatgaggtcatcaggtcgtggcagtcgttttacgggaggtgtcatctgtttagcagcggctgcgacgggtgccgggaatccttgagagatacctcctaccgggatccagagttccagttctccaagttccagttccacatgttcgagttcaatctgcctgccggacaggagttctccaaggccaggtcctaagagtctgatgagattactgatatccggcttttcctggtcagtcattcttccctccctgtttcttcctatgtgtatcagcaggctgtatgattacccgttctgcatagatctttgcatttttcaggataattttcacgccacctgccatgagcgggagttctccaaaggacataaccggagttgcgggtccaaaatcagatgagatctcttcttcagtgtcttccggcacaatccactttgatacgacgggatggtgatgtgatgtaagaaatgatttcagggcattaatatccagggcatcctgctcggttgcgattgcccctgcaacatcttcaggaataatcccactcagcatctccttaatctctgccggcatccatacgatggcattccatccgccatctgcctgcagaaatttcactgaccgcatgtactcaagtgaaataccgtgaaatccttccacttgtcgccccccggctgttgaatcagcaagagttgagaatgcaagaccattgactgtaggtcctgcaaaccggcgatgaacaataccaaaaccctcaatttcggggatgtaaaatgcaatagcctcaaaacagccacatgaggtatgcggatatccgaatgcagaatagagccagacccggtttaccgctcccattgagcgtttgatggcgtgttcattcactccggagtattcgccatgttcagaatccaggtattcaccttttgcaatcgggaagataggcccgtcaggatccattctggctgctgcccgaccgtcaaaccagctgatagcaccacaattagcatatcgctgaggggtgatgacacagatatgtgagggggcaaaggactgacagagtgcacacccgtaaaaggtgtctacttcttcatcaagaagtccccgtgcccgtgcatcccgtgtttcatatcgttcacgggcgagattataggtggattgaaactcctctccgcctgtgaagaaggtgatctggatcttttcaataatcggaagctcactccggtataaactgataagggcacttccaatctgatgaaaagagttcaggccctttgcaaatgcttttttcccgacccgcatccagagatcatatcgctggttcagatgcataacgccctggatataattcaggtattcatggatacgtctttcaaagaccccttccaaatcctcttccagtttttcccctgtaacctctaccagtataccaaacggataactcttcccttcttcaaggtcggcaagatcaggcccgagaatagatatttttccatcagttatttcatcggatttttttacgaggacaagttcaaacttctctgataccttcggacccccaagttccacccgcatatcctcttttctgatacgctccccttcatgaacaagacctacttcaaccgggatatcttcaaacatgtatctcctccatcttctgatgagtgttctctgaatgtaagaggtcaatcagacgatcaatctctgctttccaggaatctgtcttcatatttgcatacgaccaggtggcatggggatggtatttcggatccagagagatcacctttgtctggggtgcattctgttttaatgcggagaaaagaagggatccaagagcataggagaatcccgcgataaagacaaggtcatattgcccgtttccgtcacatccattccaggtcgggtcccgcagccggtcaataatctccatacttccaagaactccggataaccggattccccgttccatgacctgaccggcgatatgagaggtggttagtatcggtattctttgggttttttgaaattcagaaaccatcctgataaggatatcggtcctgaccctgtcagagatggtctcatgacctataatgatcaggggccgtttcgcctttttcaaaagggccatcaggacttcaggttttgagatgacagacgcctgttttgttcctcccatctcagcccgaatccaactatcctgaccgctcatgatcttcctcccatctgtgtccgtatctgggatttcaggagcgtcgggtcagggatgatcctgtccttgagccctctctcctgaaggattggaagcagctcttctttcatggtaattgggatatctgccggcgatcgaatgaagaggtggagatcatccggcatgataccatatagccgcttatagaggtcaatataatgggttagtttcatggaccggccacgtgaagtatcatttggtctcatgcacaatttggcaataagaaccatcgcttcttcctttgtttcagcggtcacaaagagatgttcaggaaccggcccgacctgcaccttttcaccggtccgtgaatcaaagacataccagtcctcgtcatggtctttcctgccaaggagcattctgcggtattttgcaccatgaggaccgacgataaccggaataccaagccgccagaatcctgccgcaatcgccgctgctttctgggacattgctccccatgcaaccccgacagcaccgacccggttgtagacgtagtcggcgatctcttcatagtttcctctcaggttgcgtttggcaaaaatactggctatcttaattgctgcccctgatatgtgggcattggacacacaggaaccgacgttaacaattcccccggcgtcaaatcgaccatgaaactcctcgtacggggtctgtccgtcttcattgcggtacatgccaattgccatcgcagaacatcctgttgcaaccgcgatatacctgcgtttggcaaactcccttgccatttctgcaacttcagatgcaccgttcgggaaattggcacatccgacaaaggcaataacaccgggaatctctccaaggactattggtccgccgacttcacgaatctcgatatcctgaattgcaccccgtccggcccggacaaaatgcttctcgttcaggactttttcccgtgccgctgcaaccagagagctgtggattgggatctccttattacaggcatcatcacatcggccacacccgatacaggtatcatagatatctgcaaggaaggagagatctccggtggctgcctgtttcatcgcttccggaagcggtgtttcattcggacaagcacgggtgcattccatacatccaccacagcgttttgcatattcaatcagttcttctgcagtcggtatgatactggttttcttcgtcttccggatctcatgagattcaagggctgcccggactgccacttccccgactttcaggggattcaggatgaggacacccggaacgacccctgataccagatctctcacaatatcatccggatcatcatcggtccggtcaacaaggccggcacagtttttcgaactggtggcaataagaggtgcctggatatttcctgcctctattaatagatctgcccggacacactgctcatccacaacaataaggtctggaacaccgctcctgatatatctgagttgccatgatattggcccgacaatttttgcatttggatcaaacctggtcagatcaattgctgtgcagcatataccggtgacctcaatcttcccggagagattgtgtttccgtgaatattgtatgatatctattgccggtggaacattatgtccgataaccaggataacaggtttctctgcatcgatagttccaagccctaactcgaccaatgcagcatcaggatctgccttcgggagattgaaagcagatatttgtgccatatcggcaagttcaagcccgacatgatccagcatcccggcatggaacaccttggactcaaaatcaagaggatcactttcctgtccggtatgggcggcagcaaggagctcggtcacctggctttccagatagtcaaggaccgtctcaagatccccaagggtctttggtttaatcccacagacaagacggatcatcggggcttcaacatccacattggagcccccgacatcgatgggtgttctccgtcccatcttctctattaaatggtcaaccagatgccgtccatgactgatatgagtcgctgccccgatacaggcggcaagaagcacaatacgggattgctgagcctccatgccaatcccgcatgctcctctcttccccccggaaaggtcacactttccataagtacataaacagcagaggtcacaaaaaggaatatacaatggtttgtaccgggtaaggagcatccggtcccagtttcggagtgcggtatgatcagggaaaggtgttggcccttccttttcttcccattgttcgcccttaatttttccaatcttgatgtccagatcctttatggatccggtcgagcttttcgcttcgctcaaacgtatatgtatattttttctgttcacaggtatccggccggagagttgcttctcataagtaacaattcattatggtttaatgatttacctctgttgatcattccgaatgggaagggttcgcataccccgctttagcgagtatctttgcaacagaaaccggacccggactgtcagatctaatgccgaatatgctctctcctgctatcgtccttcgtgagacttcatcgtcatatgcaatttttccaaagaaccgggtatcagggatggatgttgcccgcttcccaagttcctccggaaataaaaatcccccaacggagatgaatcgttcataggaaatcccgcattcatccgcaatttttttcgctcgttccaggtgagcaaaggattttgcagaaggtccaaggacatcaatgatatcatcgactctggctgtcacccgccggttcaggtgttccagtcctccgggtgcatcgataatgacataccggtactgtttaataagccggcccagggcatcacgaagggctgcatcaggcatacaataacatccctcaacccatttggttccaatggcgatgaaatcaaatttctcaccttcatacataccctcctcccagatccggtgctcaatccgttcggatggcggaactccaatcgtggtccctcctttttcaataaaggtgtcttcaataagttctgcaatgctttttttcccttcccgctgtagatccactccaatcatctcgccaagactctgatccgggtccaggtctacaaggagcaggggtgtctgccctgttctgatgaaataatccgcaataagacttacaaaggaggttttaccggttcctccccgtcccataataacgatggtcttcatgattttcttgttccttcaatccagtttaataagtcagttattgcccttgttgccggtgtatccaggtggaccggtgacaatcccctgactccggcatcaagaatctcttcatcatagggaatgactgtagcaactggtatatggagaggtgatgccatatctgaaatccgggtggatgattcctctcccctgacccggtttgcgacgagagcaattcgtgggatgcctccttccctggccagtcgtgcaatccgctccgctgtaaccagggatgcctgatgtgcatcggtgacgatgagcatcacatcaacatgttcagccgtgcctcttcccagatgctcaattcctgcctccatgtcaaggatgatgacctcgtcagattcggttatcagatggccgataagatttctgatgacactataagccggacaggcacaccctgaccccatcgactggaccgttcccataaccaggagggataccccgcaaggtgtctgaactgactggtttttgatgatatcatcaacggtaaagattaatttaaaaactcccgggtaatcagttttggtcttttcctcgatgatggatgtattttctgcaatgggtataatcttctcaagatcagcttcggtcatgccgagtgtcagagcaaggtttggggatgtgtcagcatcgatagctatcgttttgttccccgcagcagcatactgaccggcaagagttccggcaatgaatgtctttccaactcctcctttcccggtgacggctattttcatatgataggacctccctgaatattgaatgcctgcagatacgtatatatgaaatcacataattttcgcatcatgataatgaacccctggtttaaacattgtagattatcacccctatgaacaatatcccggaagagaagaatccataaacgaatgtacaaacctgaatgctgatagatcgtcatcaggtatctttttttgtgtatccataagaaattcatacacgatgcctgaccaatgtatgcgaattccttcctcacataagactttcaatcttttctcttttgaatgagctctcccgaatatgtatacgcacattatctgaaaacatagagtcctgtcaatgataccataattgcaagtgctccggttaacatattacatacagtccagcttattcttatgggatttttggcactcgatgaaggatgaccggttttgatttgatttttagtccatgaccagaagcttatcccatgatacagtaaggcaaacccggggatcaaacacagggaatatccccattcatatcctaagagcaggcctgcaccggcaacaccatatatccatccaagtgatacatcagcaatggatatcccgttttcatagacttcatattcctgaagattgtctttctcccaaattcctaacctgatcgctagatcacggttcattacggatattaactgacctatccagtgaaatccgaaccccattatgaggatcaatatccctgaaattatttttacgatatcaataatctgttccatacctttaacctatggaacaagtaaggagattggtattcattatactttttacaaatctggttcgcgatgatctgaaggaagccaataaaaaaacagagcacaataccatcaataagcggatgatacaattctgtatctgaaaaacctgctttcactataatggtatgtattcgctttttgctgaatgcagaatagatgaaatggggcgattaaaaaccttaacgtatgattcatcactttttgaaatgataattaccatatacgtgtatacctggcagagatcaaaaaattgatgaaaaaggggataatttcaagataaaaagaatgaaatttaataattagagacttgaaggaatataatcttcaatctctccatcttttacaattttaaacccaatcggatatgttgcgaccccatggtcatctatctgaacgaaaccgagagctccatcatatgtccggttctgataccagttagcaatacattcagaagaattcccacattcagttattgcagagaataaggtcgttaatgcatcatatccttccgccccgtaaaatgttggcatctctccgtacttttcataaaaccgggtgaaaaatggatgcgattcattgagctgcggagttgtgaagataagcccctccgtttcatcaatttctgtaagtgtatttcgttcaataaccctggttccaatgatcggtgaaagaatattattggttctcaacaatttgataacctctcctccttcagattcactgagcaggagaataacatccggatgagcttcgtttattgatgtaatattcagggttgttgcaacattattctgatcataccgtgaatcaaggacaatactatccgggagagcctcatgcagagcaatataatattcccggctgtagtcattttcgccacctatgattgcgattcgttcaaatccttcaaggtaggatacaagcagcggtaattcctgctgtactccgggtgtaaaccggattaaccggtcggatgtgtgagaccggtttattgctgcacttccaagtgccaaatggacgatgcctgtatccgctgcatcaggataaacaacgtttgtagtccagcttgatacggtaattactacgggaatatcgggatgtgattctttcatggtttcccatgaagaaacagataccgaaggttcacttcccccgtccatgattatcggttcaatggttacatccggaaattcttcttgtaccatctgaaaagcccgaatatattcatccccgatatctttaataaatccactttgcatgaccagaattccaatacaaaccagatcattattggagagcgtatcattctgatcaccctgaagatcatcctgcccactatcagatattacaataattcccggtgaagcggatatgaaaagaagaaggatcatgagcagagagtaccgttgtatcatgtatagttgggtgtattttttattttgaaaaatgttagtattcttccattgataattgtgtagaagagtgtttttaaaaatattaccatctcatctttcatttcgtggtgctcgttttctaaaaattatgaaggaatgaatcattccagatctatcaatctcattatttccgggcaatgaaaggaatggaataatatattgtagatatggacctatcggtcctgtctgataaccaaatgatatcataaaatcactctcttctcatttgagagagatttttcatatcagtccatatgagattaatcctgtaggaaaggccagaatgaaatacgtgaatctataatgatctttccatatctcatgaaaaacggactgtatttactaactttttggaaatcaaaggagatgaatatatcgaaagaatggaatatgaagatcattcgataaataattgattaagaggtatggtatacctgatctatcgtattcatctgtataaataaaactgaatctggtggcattaccatctgattatcctttattttaatctcctgaactaaatcagaaagatgtgataccatgaaccccttctccattgtataggtactgttcttgaaatggaagtgtaccggttgggtcatattatttgtattgctaaccagaatgccgatattcccattatcgtcctgacccgcaagtccatacataaaaccataggaatcagggatatcaagatgaatttttgtatgatagttcaccaagtcagaccagagagagaaggctagagcagtcttttttggctttccgttcgcgtagaagattccataaaactctggaaatgcaatagagggatcatttcccctgtagagatatgctgcatccactccggaattctgaagtgagatccaggcagcggtaaggattgctgaaccacgagatccagcacgaagtgccagagccccctcatctgcctttcctttctttacttctgtattatattcagtcaggtggttttctgcgttttcatatccaaattccttcaacaaagagtcaatgtataatccaccttcagtataatcatccggattgttggagtacatatgccaggaaagaaaatccagtggtacctggtgctgtttcatatatgtgagaaatgaacgaaggtattgccttcctttctctgattttatgcatgccggagtaactcccggtcctccaatcttcaggtctgggaatgctgctttgagtttttttgccgtcatcgcatataatctgaaaaattcctcctgggtatgtggtttcggccagaaatgaatattatctggttcattccagatttctacaccggtgatgtttgaatgaaagccatcccacagtccctgatggtaatgacgaatgacatgtactgtagcatcagaccagttttcatgttcctcgggagctggtggatttacaatttcatacccatctccgatacgaaaatatggctgaaatccaccattcacaattgctgcaaaggtatcatcactcgaggaaaaattgtaacaatccctgatttgtggatcacacattctgttcgggtagagtatcgacattgaatgagcaccatatatgtcatgattacggattgattggaccccgatattctggtattgggaggtaatatcaggattttttggatctccaattggagaagggccggcatttatccccagaagtgggagtatctctccggtaacctgggagggatcaatctcaatctgacaggaggtagcttcggttaaaaccggatacatgagtgcgatgcatgtgatgagaataataatttgaataggatttcttttcattttcatcatggttttcttggtttttgaagcgaaaattgtttctcttcacggggagtttctgttaaaggaaggccctctttgacagaatcagaggtaacccgttcatatgaatagcgggcattgatgatatcatctgataatgttttttcgggtaaaattccttcttccatgatttcactgaccgttctgctccggcttccggtagtatcacgtgcatggatatactcaaagaatttgtatgttgcttttacctgttcagaggtactatgggtgatagctccaaagacactattcacgtttgaattcgccatctcctgttctgcctctcgttcaggttccatggttccgattatccggtgactcagccatcggtgttcagttccatttactgttccaacaatgatataatcatttactccttttccctgactttgtctatcggaacgtataccaggatctcctgtgttgagaaatcctgaacaggtatcatatctgatggtggaagggagaactgttttatcctgttcatcattggcacaaccagatgatatatttggatttaagggtgctaatgcatccatcatgtcatcaagtgttcccagatatggttcagggtttttggtatgcttcaaacgctctaatcgtgcttcttccggagaataatccgtatatccatcccagcccccatggtagatactgtgatgatgaagagcaatttcatgtccattttgttcccatgattttacttcggatagtttttcgggatcagatcctatcatctttccccactggggagtgaacataagggttaatgaaatcccataggtatcagccttatttaccatttcttttaatacagcatatgagggtgttgcaccaatgatcaatatcatgcaggatcacaaatgatcgatctctaccccttaagctatcaaccaaaatagactaattgatgtatgaacctgcatgtatcaattcccactttacatactgtgtttgcaaaaatataggaaaaacctgaacctcttgacggttttataatattcgtagcaaattctttaattttaactataccctcaaatctgataagtttttttatattatgcactaatgcagctaaaaagaattctccctcgcaattctctttccctttttgagagaaactcctaaacctcatattatgtttcatattaccaaaaactggttcgaccatgtattttcgttttcgatataactctctaccagtgggggatttcacacgtacttccataactcgtttacaaatttcctgagttgttgcttgtttctctctgttcataaaagattgccaaacaaacgtcccgatactttgcaattccggaaatgtgattatttctcccatacaaatcgcccgacatatcatttccattcgtgagatatacccatcattatctgaatattctggaatttttctttctttagaaggagggatgatgagttgaatgccataatccaattctgctaaagaattcgggtatgagaaataacctgcatcagatagtagtatattaggcgaaattgatggatgaatacccgtaaaaaggtcttcgagttcatttagcataggtattaataattttttatcgttttgctcatctgatatcattgcagcgaggataaattgattttcagaaacgataatctgcccattatacccttgaatccagccattggtggttgacattatctgactttcaggatcagtgagatttacttttgaatctgaagatggctcttttttaggctctaaaggctttctacctcgtttctttttacccgattctaattcttctttttcgcggtccagaatctttttttcttgttttttagattcgatatcatgtcgttcaattaatttctctttagcccgattaagaacttcctttcgtttttcttttgttgaaagatgctcaggtagtcggttaatctccatatcctgaatatttatatcatcgttttctaactcatcaatttcctgtgattcatcaaaaagccgacctagctctgcttcaaggtattttaattttttattggctgataaagaggcattacagccaaattttgatccatcgagggctaggacaccgattcttgctatcccggattctacgataatttgagataattgtttaaaaagggatttgatttcttttgaattattcttcttgaaacgatagatcgttgtatggtcaggtgtaagattattggcgacaatccgatatccaatatcataatggcagcacatctcaatttttctgctagatttttctccacgaatcattgaataaattattattccaagcattgaacgaggatcaaaaaaggcagaaccgcgaccatcgtcacgatatttattaataaatggactaatatcgagaatcgaaagaatttctaatatgccataagtaatatcattttcagatagccagtccatcgcattgacagggagtaaaaattgttgttcattaccatatcctctaatcatgttatagcgatgagacatataatatattgatcttaataatatatataattaagctttaataatttatattaagctttttttgtgtttgtgcaacagcctcatatgcagcctttaatttttgttcctgttgaaatgtcccgtgatatggttcattatgcaccgcgataaagtaaaaaggaagagatgggtcggttgtattttccgggggcgtcaatggttcagatattcctggtgatataataaagccaatagagagaataataaaaagaatgaacatcccatttcgaattttcaggagatgtttatatggattattcatgattgttgactgtaggacttttgaagtataaagaattgtgttcatggaatcatgattcatcttggagaaactctgatgaactgagtgactgatatattctcggtgagagaccataacagatcaggcatgtataggaatcatgctcctgctgatataattcggattcgtaacaggaggatcatctgctgctgttccggccctacgggcacatgaggtaccaggtgcgttgacgatgcttctaccagccgggtggaatattgacaattttcagtgtcttggtattagtgtaacaaacccacaggacccgacatacgggattatgtttctatcccaggtgcatcaatatccaaacctgcttccccttggaacaactcctgaacaatatgtggagaattacttcagtcaggatctggcattgggaggaaagttcgctgatagtgttcagattctgggttatcctgatgcagatgtgagcggcatcagtgtctttggtgggatccatgtcaaacctatggaggtttctctcagaataaacggagttccggttattgcatatctgaccgttgggacctatgatatctatgttgggacggttgtagcatacctctggggaatttatgggcctgcagctacttttgcagaagatggtccgtttttaaaacaagtgtatgattccatcaggtatgatgaagattatatggctgaatccagaagattgatgaaatggggagactaatccaattttttttatattttattcttacttataattaaaaatccaaattcttttgatctgaaaaaaaagtgaatgatcttatcattttctgaatctttattttctgttatcatggaatgatcctggtttcgcacggatttcaaaacgaaccccttttcctggagttccattttccacaatggtaagattcgtaattgcgagaatgtcccgggagagtgcaagtcctaaacccgtatttttcccatgaccccgtttaaatattaaattcttttccgattcctcaatcccacatccatcatcagtatagagtaccagaagatcctgcgtatcatattcatacgataatgaaattgtggtgactgtttgtccgtgtctgactgaattttctattaaattgtatattaccttttcaatcatctgatctgaataaagtaaaacacctggttctggaatttttaaaataatattcttcaacaagggacttgaagaaagtttctttaaaatatttgtaatatcaatccacataggttctgaaattccaagatcctgatattccccggtaaatttaataagtctggttatttcagtcgtactttcggcaatactattgagttctttttgaatggaaggatctgttatatccattttcaaaagttctgttgtcaatgaaattgcagtaatactgtttaatatgtcatgccgggtgatcgatgaaagtattgataatttttccaaagctttcttcagggcaatttgagcctttcttaatggtgtaacgtcaatcgtcagaccaataaaatataatctggaatcatcggtttttcgataactttttgcatgtgagatatgatatttaatatctccatctttcccaacaattcggtattctgcagatattttttcattctcttttgttgcccctttaatgtaggtaattaaacgagataaatcctcgggataaattaatttttcaagggataattcaaatgcatcatccggactttttatcccagccatctcaagaatttgattatcccctgtgagcttgagggtatcctggtcaatctgccagagtcccattccggcagtttcaacggcaagttcatatctggatgcaatcatttccttttctttaaagtacttgtcacgttcccgtgccagacgatccagatttaaaatgatgaaaaggagtgtcgctcctatggagataaataaaattccaagatataatgcactcgttgatgttgtctgttcaaaaagagttcttcccgttggatggagtgtaaagtcaataatcctaaaaatcagagtaaacccgagaaaaccatacaagagagaaaggagtgaagaaataattttttcatcatcggaaatatttttgaaaaatacatgtgctacctgaaaagctataatcgctgaaaaaccactgatcattactgtccggaacgttatatcatcatacaataggataccatacactgcaccaatgaaaacaaggggaacaatgatgtaccattttttatcaatgggtttattataataaaaccgatgagatgcctcgaagaccattaaaatagccagtatattaaaaacatttgatagggggacagaaataattggaggaataatgtccctgaaaatcatattgctcatggatattattaaaaaaaataaatggagagcccaaagagtgaaccctggatatcctttttggcgctttgtgaataacatcattattgttgccaggaaaacttcaataatgactattgtaaagattaacgtcttaatatccaaaaaattcatcatcaattactatcctgaataataaagagagtgcattattcattattaatattaactcattgttttcagattactgtgaaaaccaaggatgtatcttccattcattcggtgatatttttaaaaaaggttttttcagtacagaaatgtttttgtcttgcattatgaaataaaagagaaagaaaatttcaaaatttcatatatgttcataattcaatccgggggaacatgaaaaaattaggatttggaacgcttcgtcttcccctcaccaatccgaatgacaatgcctcaatcgatcaggagttgttcagccatctggtcgatgagttcatgggagcaggatattcctactttgagaccgggtattcctatcatctgatgggtgctgaagatgcattacggagagcccttgttgacagatatccacgtgagtccttcattcttgcggataagatgccaacatataacctgaatatcgttgaggatttggagaatatcttcaccgaacaactcagacgatgtaatgtctcattttttgattcctatctcattcataacctgggggaaagccggtatccaaaggttttggaatttggagtctttgattttattcaccggaagaaagaggagggctttattcggaagatcgggttttcctttcatggaactcctgacctgcttgaggagattcttacaaaccatccggaggttgacgtggtgcagctgcagatcaactaccttgactgggagcatatctctattcagtcacgacggtgttatgaaattgcacgaatctatggtaaaccaattatcgtcatggagccggtgaagggcggaggacttgccgtaatcccgaaggaagcagaagatctcatgagagaggtcaggccggatgattctcctgcttcatgggcgctccggtttgctgcaggtcttgacggggttatcatggtattgagtgggatgaatacgatagaccagatgagggataatatcaggacttttgataatctgactcccctttcagaaagggaacatgcaatacttcaggaggctgcccggattatcagcaggagtattgctgcaccctgtactgcctgccggtactgtatcgacgtatgcacacagaatataccgattgcagttcttatctcgatattcaatgatatgaaacggtatggagatcggtcatttccccgggtgcattaccagcatgccgtgtttggtcatggcaaagccagtgattgtgttgcgtgtggggagtgcgaacagatctgcccgcaacatctgcccattcggaaaatcttacaggaacttgcagaaaagttcggataaaaatgtggatgtggtgaatagatccgtgcagatccatactcacaaaaaagggttagagagtctttgtaaaggttacccggtctgcatttgattcaggattaagactctcatgaatgatggcatccatggacgacccatcttcggagatggtaaagatgaagatacccgtttcggtccagtttccggaatattctctcccatcctctgatacggtgccattcagatctcctgactcgtcatttactcccttcagcgggtgatttgtcccggagatcgtggtgccgtcctgaaggaatgaatagatcttccgttctgtcgtccagttccctgtccatggattttccggatccacgatctcaccgattctggttgcaatcgcagagtgaaggacttgttctgtcatagttccaaacgggtcgattgttccgtttatcgtaaaggacatgttgtcatccgccagagtctgaaccacggatcctgactctatccagacccctgaataggttatcccatcatctgaaattgagccttccagtcttccaggatctaccattacaccatcagccggttcatattctccggtgatcccggtagcatcctgctcaatgaatatggtgaagttcgtgccttcccatgttccattccagatgtaatctgcacctgcatcagaaggggtgtcttcagcagatacgaacgatattgaaagcagagcaatcagtaccaatatgccggtacacatcatttttttcatggagtcccacttgttcctgatgaaaaggttcttcatggtacgaattaaggatatcgaaatgagatgaatagttgtttagttacctggtcaaaacccttgtgtttttagggataagacgatttcatcactcattcctgtcgtaacgtgtcctatcctgcaattgattgatcacttcatctcctgtatatgtcagatcttctctacacaaatcaatctctttcttccatcagaaacaaagccgccttcttcctgggccagtcccggattattcccctgacctgagtgaccaggacggcgtattcatcggagatgataatccggttcccggattccgatagtttcaggccaggaacagtaagcccgttcagcatcaggatgagatctccggtcgggatagatctgattaccccattcccatccgtgataacgtcaatcataccctcctctccgggacggagcctcccgaccttttcatacctgatgggtggcttgtctcgttctgatgtcacgatgaatgtcactgtccgcccccgttccgtgcctgctcccgggagtaacaggtagaacagataccggtctttgtttcattatcataccaggaaatccccccaaggttgcagataggacatcggccatagtccttatctgcctctaccatccgggcggtattcagcgttccgggaagggtgataaaggacaggctcaccctggcaaccgcctttgaatagcatttctgacagaggacccgggaagttttttcttctcccttatcaccgggcggttgtttttcggtgtaatgaacccattttgctccacagatagcacatggtccggagtggatgccgtgaactgtagtatatgcttcaggatcaatcgctgctatggtcaatctgacctgttctctcttctggggtgggagatcatctggtccgggggaatcaggatgtttgtcccgcccctcagtttttgtatcggatttggaaagggcggttggatctttcttattttcgtatcctgtattgtgaggggtgggagcaaaatccgcagtgggtgatggatagtcaggtgcaggtgcttcatatgcaccctcaccttcccggcctttcgtattcttagtattattatttttataataagaggtattttcagattccactcccgaattgtccgaatcatcaggggtgggagttcccgtcctgtgcggattttctcccgccctcccactcctgtcgtcatcatgatcagggctctgcttatcctggtcagacccctcggaatcgagccagcaccctccaccagatacccagttctggtatacctcatcgtcccagacaaagcacttgcaacttcttctgacacgccattcctcatccgtgacggttcggtcaaggtaggagacagcaggacatttctcaaggagccctgagtaatcctttccataactattgtatccgcagatctgtttccggatagtccgttctgatgaaccggtgagtttagaaagctctgcagcggtgaactcctgtttcccgctcctgagaacggtaatgaggtctgattcacttctggtcagttttgttatctgacttcctgattcaccattgagtgcctggtatatccggtttgcatacctgaaatcatcgatatttgcatatatgaccggctgcccgtgtgcctgtgttttttcacgctggaactgacagagacatgcgatggatttgatgagatccaggagcatccccgggtttctccggttcgctgatgaggtaaaccggatccgggttgcatagggaatgaccacatagaccggtgagagttgttcccatatctgctgacatacgattacttcatccctgtttaaggtctcttctgtaggaagggctgcggctgatgcaagttcccgtaccagcactttctcatcctgctcacggctgtcatctatccagcaggtcagcatccggttccatatctggtcatcaccggttccttccttcttggcaatccaccagacacaccgttcgggaataatgcagacctggcctttccggtccttattgaccgtccggtagatgaacggttttttaaatgaggtggtcactcctttgagcgtctcctgcattgaatcagagagggagacatcatcaagacagagggcagtgccgggttttaagtcttctgcataaaataatgccttatcgctgacccggccatccagacgggagtcctgggggatgtgctggatcatggtatcaaaggcatgactttttcctttgccagattcaccggtgacaaggacatgaagtccgtttgaattaatcaccgtccgggatgcaaatgacatgatcaggcattgggcgatgacgaaatcaccctcatgttcctgtgcgaatgagtttaggatgtactcgatagggttaccattcgtgagaatctcgtatgccgtctttcgatgcaatgagatatcggtatccggattcgtggtctggataatttccgtggtctccggatggttcccataatattccgcctttgcctgtgccttttcgcggatactctttctccggtacgtttcatagtcctgcttctcccgtcctttggttccttcgaaccgttccctaagttcatgccatcgctgcctgcctcctccgcaggagttatgatgacatccggcgaagattcctccattgtcaaactgaatggcatatgctccgtctgtgtgagcagtggagaagggaggtactggcctcctttagaactgaacatggtagtttaaaaactcactccaattccaaagatgatcagtaatactttctaacattgctggagacttgtgactactttttacttcgataaaattatgcacaaattgaaagatatttagcgctgaaatgaatctattgagtttttttgaaaaagaggcagttttccttccaaaacggctcaatcgttgtctgattttattattgtagccctcaatgactgaggtagagattgctttactatctggatttcccataattttctctcgaatgacataaacaagtttattcttctcttttactttgatcacctgaccataatccaagcatggctcacaatataattcaggtaaacaaatgctatattggacgtttccatcagtaaaaatcgatattttgttttctggcgttggaagttccattcggttaaaaaatcgaactaacatatctgcacaagtatcaatatttctttttccagattcaaatgctaaaaataatccagaatcccttttaaaacaagtataggaccaacaatcacctaattcttcagagtcagttgttaggagattcttgtttttttttgaacaaactcccaaatttcatccatctcacaatcccccgcggaaatgtcatgaataaaataatcgttgagtttttcagcatgttcaccgattaagtgataatatcgagatatagtgtcgcgatggtgtccggtaactcgagatactcctcgaattgaagttttttcagtcgagtgtttcgcaattatgagaacagcagttcgtggtaaacgagaatcatacagaggagtatttttagtttcaataaaaaaacgtcgacagtgatggcaatagtactgttgattgcctgcagaattatgcccatttttagtaatattctttccatcttcaatttgaaaataagtacaatccggattttgacacgtaatcaatataggaccacgttttccaaccatgaaaataattatatctaaacttatattaatttttagtacataaaatttaatactttatttgcacttagtattaccagcttgctaacagggcactaccagaagggacagtgatcaaagaggaaaattctcccaccagcgaatggtttcttcctgtatgagaggccatgtgaggagagccaggctccgagatcctctcctgaggtactggttccttgtgcctccgaggggttcatttccactggacatccgaaaaagagcgatgagagatgagaaatctgttgatactccacaacatggacttcttgtggaacttccaggagaagagacctgcgatgaggccgggtactggtcgaatccctttttcttgagagggttccgtataatttccatatcctggctgcatttgagaccgaggtatcaacttcagactctttgtcagagaagaatgtggagaggacggtgagggagtttttgatgagcgttgtgctctcctgggtatttggcaggtcgatggcatagaggagatgggctccgttcccggagtctgcaatgaccgcgtcaggccatcccctttcggagaggaattcccggatcttttctgccttgtcacgtgctgcagcatgttctgcatctgaagaggatatcccggcaggcctgaccggatcaatgtcgattgggaaccagagtcggtgcatgatatctccatccgatgtctgcggttctctttggcctgcccgtttcatccgatttgcacaccgggagaggagatcagaatggacctggtttaaggtgatgtaaatccctgatatgcctgatgtagagtccagaactgctgcatctcgtgccagtcggtcaaaatccgtgtaatacccgtaatgagtccgttcaccaagagccctgagctcgactactgatccctccggaaaaagaacagagagagcggtccggatggattcctccgggttcatctcctgacctccggatggttatggatatgtccttcctggtccctgacttcccagacaaaggatgagggacggactccccaggactgactccagacgatgaacatcgcattcatggccagggtgattatccgacgtcgcccctttctgctacatccggctaattccgtatacctctccggatactggtctatttcatcttcaatctggaaccggctgatgagggaatcacatggccgtattgcattgagaacggccttcctgacctctgcatggtgccgtgatctcataatcctgcctccctgatggatatcgctccgccggggagtatctgatagcgggaccgcccgcctggatggtagagccagagttctgacctgccggggaccattcgatcctgcatgagggcagagatttttgttatctcgtcatggcaggatctgatgttttcggttcgtgcagtgcatacaagcaggccaaggatggtgtcacggttccaggcgatgagatcaaagatccgatcttttccgcagcaccggtcgatgagatagccatgtgttttcagatcactgatggcaaaccagatggcacatcgccgtgtttttgtttcagacgacatggccggctccggttttttgtgggggaaatgatattatccgtataaatctatagcttagaactgcccctgcccgaatcgttatgccggcaagctgaatgatagagcgggggtattctcttcgtaatcgtgctttttgtcgcatggtcttctccatggttgttttttgttctggttttccggattgtgtataccggaatagattctcccgatcatcagggtttttagtcgagagagagaattggctgtttgtgttgtcattggtaaatccctgaatgattcggggtcttcttagatggtttgcaagtactgatacatcctgttttgcatctggtcccggttgtttctgggagggcatcggatgtttcctgaataattgcggtaaggggttatttttcccgaagcggcaataggtgtgatttgtgaggatgaacgatcctccattcaaggttgcatgaaggggtatttgaatttcaggtaaacagggtgaaagtgaaaaggggggtaagaacggagaacggtgtgatagttatccgggtgattggagtgtgggatgggctgggttttactttcgcgaatagggtttagatatttaaagatttggggctcatggtttggaaaaatgtgatcgagagtatttaaacgccctaagagggagcggggcaggtggtgcctgggaggaggtacgggagtgtggtggaaaagagttgggtatttgaggtcaggtttttcaaaaaaggagagatactgctggtcaccgattaaagaattccagatattcttcatttgtcaccccggctgtacggattaacttccgaagcaatcctgggcccagttcttttcctgaatgcacagggatcgacagatgaactgggcttccttctttaatcaggatataatgactgccttcgatatggttcactatccatccggctcttttaaaagctgcaacatggagatcgcctgatgccctgggtaatttaggcatgggtactttcagggatctcaaaagagaaggagaagttttctggattattgttcaaaagtttgcatgtggcagttttaatccgactggtaatacagccggcgattgcttcattgatagattccatagcttcttcgagggtttctccttcagtcaggcagcctggaagttcagggcattccataacgaaatgtccctcttcatctttttcacagaggatggttagtttcatgatgatcaatacgattattaaaattcgtaataggattttattttttgagcaataaacatctttctctgatatgccaggattcaaaataatttcccagagggtgtctgagaaccccatttatattctccaccgataatcaacttcttcgctgtgagccgataacagatctctgcaacttcggtatcagggtacaaagacagtagactaaaaatatctggaatgcatattagtgattaggaaaatgacatccatatgcaagaaaattgaacaggaagtgctttccctccctgctcacgaacgaatagaattgattgatcgcctcatagagagtctcaaccttccctctgatccggagatcgatcgtctctgggctgaagtaggggagaagagattttcagagctggaaaccggatctgttaccccgatatccggaaataaggtcttttccaatattaaaagcgctttaaatcaatgaatttctattttcatcccgaagcagaacaagaactgttgcaggcagtatcatattatgagaaatgtcgtccaggacttggaatagaattcagtcatgaagtgtatctggcaataactagaattttacagttccctgaatcatatgcccagttttcaactcattcccgtaggtgtatcctgaatagatttccatacgggatattatattcacccggaaagactgacggaagtatcatcatccttgcggttatgaatcttcacagaaaacccaatcgatatgttaatcgaaatatttaggtcttttcacaagcattcacttaattcttaattattctctcccgattataggataatgcaaaactttctgaaataatttcgaaattttgcataattctatggagtgcaattcaaatgcacgtcttggaataatcttttttataccgaataatccaatccgttttgcagggctctataaatttttcactgggatgaaaaagaagataatgaaggaaaggagttccagagttaatgctgagcaactgcaggggagttagatgatcctttctttttcgaccgaatactattgagcgtggtatcatctaatggtgctagattgagttgttctgcaactgtatcaaaagctttttctgctgttttttcatcatcatctgtaacaggaacctcgtttttggttacccgtagggctgcaggaggtgatagaaatctattttcttttttcatgaaatcacgtgattattgtttattaaaaattgcacaaacacctgatggcccacttctccttcaacggagagatatgctttcatactcgtaatataatacttaaatcctttctgaaaaagtactgagagaactggaagagttcccactatatggaatctctactgtgattatctcaaattttttgtctttctcaagcattttcagatgtgtttcatagtattctttcagtccaatttttaatcgtgatattgcttcttctcttgtttttccctgatctgctacatctgttgcaagatcaacggcgacataccattcaccgtcctgatatgtttgtacaagagtatccatattcacatgttatctcttttcatagatagaatgtgaccgaaaaaaaataactgaaagtttcttcttcattcaggcagcctgaaagcttcgggcattccataacatagtgtcctccttcatcttattcagagaggatggttcggttcatgatgatcaatgaggtaattaaaattcgttattgtatctcaacattgccacataagaattatgttcttagagacgtatgaatcgagcaaaatgcccaaaaactaagaaccaatgaacttgagccataaacaataatatcacgatagtaaataatctcgttgagagtctcttgtcaaagtggcaaccatagtatcgtacctggattcatatcgaaacaaacatatcgcatacagagcgagatgaattatgaatcgttccctatcatctggattcatatgtgtattcatcctggtttcactggcaggagcctctatagctgatgaatctccccggtacgtcatatacgttcagggcggtgatagttccatcattcatggatcagaaggaataacggatattattgtaaaggatatcattccgtatgtccatttttcagatgggaaaaaaagtcttttaattcctgatacactcgtacagtctatcaccggtccggttaatgcagctgttgtcttctccggtgctggcggtgaatcagtatctctgataaggatttcaaatctgtcgttgtctcatgaaaacaaggttctcacattgggtgtacatccgctcgaattttacgaaggagaggctctgaaatcctttgctcgtgaaaagaatgaacttgatgcgattgaggtcgacaagtttgaaatcacgggtatttattttgaaataatcgggacagcacttgaaaataataactgtctggctcaggaaattgcatgtctgaaggccgatgatgtgaaagcgtgtttaggagagtgtgggtaaggccagatgggagaggtaagggataactgaaatgctgatacccgtatggacaatgtccaatatcttttctcccgtctttttttgctgaacgggaacgtgaatcaattgatagtatgaatgatactttcaaaaagatatgggaataaaatagttttaattttccaaatttgttttccccttttcacctcatcaattacctagttcatcgtatctatgaacatctggagagacttcggattgattaatgccttcaatggaaaaggaggtggttttcgcagactattctggggaatactgaatcctggaatttcatttaatcggtcgagcaactcacttcgtttctcctctttatcgaaagggagatggtttacctggtattgaaactgaatgtcgcctgtccctgaagtccagataaacgtcggataacactgattattcacatgtgtcagtttttatccgactggtaatacaaccagcgattgcttcgttgatagactccagagcttcttcgagagtttcaccttcagtcaggcagcctggaagttcaggacattccataacgaaatgtccctcttcatctttttcacagaggatggttcttttcattaagatctcaaagattaatacaattcgttattgtatcttattttctgagcaataaacatctttcccttaaaatatggatggtatttttaatatcccagacggtgtctgggaaatctggtgtggaatgcaaaagatttcctaaaccggaattattctccggagggtatattatcgggcaattcgacgatgattccagatatggcagattctttaggtcaagtcccaagagtgaatttggaaaaattgaagaattgataagattatgtgatatgataacgaggtatgttcaatatcgtaaaactgatgtacattcatgaacaatacaatcagtgacgatgactactccaccacataatattcaggaattcaatatttcaaatcttgatgaagactggaaattggcaaccgtatatgccgcttttatctctccaaagacccctcaacaggctcttaaactgatttatcatggagctactacgggggtgtctgaaaactgggtaataaacacacgaagaaaattgattgaaatgggttatattacgaaagtagacgatgaagattctaataccctctataaatcagatatggggcctatagcaaacctcatcctttcccatcagaaagataattttttcaaagagaaaggtacaaataaaatacatgtaagacagctttgtagattaatccagatcttgaggcataatttttcaataattcgtattacactgtatgtcttatcatgaagatagagatacttctctgatccatttctttaacccagacgcgcaaatgtctcactatagtggtctaaactacaatcattgaaacttcaaagagacgatagaaaaaaagagagaattacgagtattttccggttttttaacgataactaatagtacataaccctccttcagactatcgatccgaagataaagacctacaaaatttcagaaaatttcaatgagagagtttcttttatgttgcggctttttgcaaggtgccgcagtgatttttctaatttaacccatcgtttgtttacgttccctttgccaaataaattttgattcaaaacactcaaaaactccaatcctttctctgaaaatacttttgaccataacatcggggtatattttcctttatcattttttcgagacgtagatacaatccaggaaaacagatctctgctaataataaaccgtagtaacatggaataaatgtgaataaacgccattggctcatttccgagaaacatttttccaaggtcgtaatccccttttaattccttaaaaataagttcaatcacccaacgaaatcggtataaatcataaatatcatcagccgaaaataactctttactgatatttgtgatatagaggtgccatttttcagtaagaggattccaggtacaaattaccctgaattcttgaaaaattggagttttaattttgttaatccgcttgtctccaacatgaaatgaacaaatgagatcataaactcctttttttggcattagatctaaaaaatcgtagccattaatgcttttaaaacgaatatgatcaacaattgatgttatttcagaaggtcctgaattgattgaaacaaccttaaaaacagcattgctttttattctactaacaaaaaaacctccatattgttgaattttagagaaaatttttagagaatagtatcccaggtcgtttattaggagaatattctctatttcaggtccaatttttaacatcttagagtcatgaaccctttctgttgttataattgcattttttactgaattagaaacaacactataaattgcatggatctttaatccagcagattcatcgcgagaacgtgctgcaggatgcaattcatagagttttttactaattcgaataatactgctgtcttgaactaaaatatctttgaaaccccctacaattccctttaaatgagcaggagactgatgaaccatttgatctatataatgttccatcagtgatttcagaaaatctactaattttaaattaaaccgcttcctgaaactttggctacgaattgaggttagtatctttggattatcatcaaggtcaatataatgacgatggatctcgtctaatgtgggtttcatatgactgctgactccaaaaatgagggtaaatatcaaaagaacaggatcgagtttcctttttctctgcataaatcctgtttcccgagctgtcttttcaataaaatcaaaggtaaatttttgaaatacccaagattttaggttttttagacccttagaagaaggcttcttcatattctttaggtcgcccgacggtgctcaccgtagggcggcgccgaaaatatataaaggtatcgatttgtatttgaaaatgtattcttgataagtaacactgattttggctctgttaggtatcaggccataaagctgtcatgcatgaaataaaataattaaaagtctcttaatatttctcaactctcaatggtttcgagattttttcaaagaagaatatttttatagtccaattcggcattctgacatgaccgtatatgacccgtatgctgatatgtacatcaaaaccccctctggtcttaacacaaaattggaaattgcgaatctctctcaaaggatatctcatttactctatgatattgggtattacagtcacaacctcaggtgggatatgttataccggtttcgggaagatcgggagatcgatgagtcggatatcgtattactagaggagttgatcttacttggtgaatttgatctccttattgaacataacaaaatgaacgttccttctaacttgttgattcaactctgttcaataataaaatttctgacaaaaaaggaatactgtgggaaagcgcctctgcaactttttcagaaattattccaatcaggagctggttgttttatcccaaccaatttttctttaatgttcagattaatgcccagattacctgacaccccggaatatctggactttggtttcatcagaaagatgatgtattctcaaatgtatgcgatcgatccaaattgtatcactcattacctgtccggagcacaattaggaaaagataatttataagttcctatcaccaccagtttgggtgggtgctttttactgatttaattatctgcatgattccatcgggttcattgactttttcaatccctccggtgtattcctttttttgtaatgcagtcacgatggcatggacagatactggaagtgatgcaagattatatccaccttcaaggactccgatgacattaggtgtgatagaagtaagaatctgtcttgtcatggtatagtaacttccagaacagagacagagagaagagagagggtcttttttatgactatcctgtccggctgatatgacaacagcatctggatgaaattgttttcctgccggcaggatgatctcggaaaaaattttcatatacgaattgtgtccggtacctggagggaccggtatattgatggtgtatccctctccctgtccaactcctgtatcctgaatttctcctgtgccgggatagagaggagactgatggatggatgtatagagtacggaaggatcatcgtaaaatatcgattcggtcccattgccatgatgtgcatcccagtcaataatcatgattttttccatcccatgcatctgcaggtatctggccagaattgctgcattgttcaggtagcaaaatcctccaccccggtcggcatacgtatggtgtccgggaggacgattgaggacgaatgcattctgagcttcatcctgaataagcatctcaccggcggttaaacaaccaaatgcggattttaaggcatgttcgtaatgaatatccgaataatcaacagaaccggttgtgatgatattgttgatatattccggggtatggacctgttggatccacgattcatcaaatacccgtggttcagtaaacatttttatgtcgttttttatcagatactgcgcagtaaccttcactctgtccggacattccggatagttttcatggttttgaaagagtggtgtgtaaataattcccgtttccataattcacctcttttttcccatccgggagcaacaccactccatttgcgggatgattatttgaactgaagccataaaatgaggattattttgtaggtggacagaaatttttcagaagtattaataattattgatttcttgaaccatacctacaattcctattgttttttgtagcgaatctctttaaatctgatttgcattgtaagattcgatacaatgcggggtgataaacaaagaggcgaatgttcatgaatcgttatcggattttattctgcataaacagattggtctcatgaataggggacaggaatgtgtggcacgtgaacgctctgaattacatgctaccctgaattattgccggaggaaaaagatggaaaatatcccgaatcaggaaggacaatgctggattgattatctgcttacccggataactgatcttatcaaaattcaagagtatgaacgtgctctccctatagcagagcaggctcttttaatgctgcctgacaatccagatctcatctatctggcttcaaccatctatcaaaatcttaataaattcgtaaagcagcttcgtttacttgaaagattacgcgatatcagaccttttgaccaggatagacgatcagctcttggcagaagtctcatgttccaggggtattattattctgctctttcagtgatgagtcattttgacatgatgtcaaacgaactggcagggtataacaaggtattcatgcattattgcaaggcatgtattggggatacacaatcagttatcgagtactgtgactgttgttttgaagattatcaggatgagcccgatgcagccagctttcttgcgatcattcgtgccctgaaagttatgtctcttattcagaatcaggagaatgaagctgctaatagtcttgcttgttcgatcgatgaggaatttgacaagacgctatttgtggcttatgccaaaggaattgcagccagagaaaataataatcttgctgcggctgaaaggttcctccggcttgcatgcacgagcaatcaacgagatatgcgggcgaggaaagaactggctgatcttctttccgtgcttggacaccatgatgcagcagctaatattcgaaaggagataaccggtttttttggtccttttgatgatcatgaaaatccactatacagagcaaaagaattcataaaatcaggaaattttgatgaagctgagagatatctcttatgggttcatgagcagcaacctgatcggaatgacctcattcttcccatgatatcattgtgcaatttcaccgaccggtatgattcagttatttcatatgctgattctcttgaaacaactccatacgcctggaaatcaggatatctgaaggcatctgcatattattctgctggtgatgccatgggagcaatccggtgccttatagccgccatagcccgggatcgaatattttcgctcattactatactgaatatgaggattgaaggctatttcagagatccggatatttttgatcctgacggaatggctttgatgatattttgcactgatggatatgattcggctattcctctctttgaaatgttagtcgatacaaatccggatattttagaataccgtgcattcctggtatattgctacattctggaagataaaaatacagatgctgctatctgttcagaacgattatctatgtcagatgatccggatctgtgtatggtccgggcccttgccctcagagcggctggttgtctggatgaggctaaacaggtgacggagaagaccagaaagaggtatccggattatctacctgccctgaatatgtatgtccgtattttggttgatctggatctgtatagatccgcatatttcgaacttctctcgtatcaggatgttcttctgtcagaagcccctctcatggaggttttcatccggtgccttattcattctggagatttccttgaagctgctacttcagcctttcgtctcatcatggccaatcctgacaggcctttggaatttttctttctggcacagacctttatgcatgatggctatactgatgctgcattgtatgctattcgtgagagttttcgatttagcgggtttaattcaaagacattgcggctgtatgtcaagcttctgcttcaggcagcatctcctcaggaagcctcgatttttttctctgaatgtgatgattatttccccgaacagtcctgaagtccggtatctgaagaacgcagctgcacttctctcgggtgagaattcttctgacgaatctgttgaagaacgtgtggtccggatatttcagactgaaaacggaatttttcgcggttatattggtgaatatagaaatgcagtcggaatgctcacagaagagataaagaagaatcctgctgattattcgcttcgtgttgcgttagcacgggtcctatttgaactcaggcaggacagagaaggatttcatcagttatcaatggcgatagagaacggagaggaagacaatgaaactctggaattgatgaatgcagcattgaatgcactcagtctaaactgtttcattgatgagtataagcggatatctcagggtgatgtggtaaggtttgctaaactggtgtatgagcaggctgtccgccagaacaggttcggagttaggagacaggcgattgacgtctgcaggttcctgacaggtctttcatcatcagatccagcagttctgagtatcaaggccgatgcatgtcgtatactcggagatcttgaggaggatccggagaggtatgaacaggggatagcactatacaatgagctgctttcagatgatcctgataatgcccggtacctggcatataaagggcttcttttagataatctttccaggtatgaggaagctgaggatgttctcgtccgtgctctggagcttaatcccgattcgggtgttgcaaattcagctctgtgttggtgtctggcagctatcggacgataccaggaagcgttattgtatggcaacaaagccacgattcaaatccctgatgattggggagcctggaacaatcggggacttgctaaactaggacttgaagattttgaaggggcggtatcagatttcaaacaggcaatcaggtgtcatccgggagagctaatcccgaggaataatctctgtgaggctctcctctctcttgatgatgctgatgcccaggatgcttttgtggatcttttgttcagattcgggtacatggcatttcctgttaaagaggtggaggagtcatggagtgttccgggtttgaaccgggatcacagaaccattaccggctatatggatgggtattggtgagcatattacgtcagtatttttgaggaggtgataatcatggatatatttggattctggctgcatcaggcgttaggtctgcatctgcaggaggaagaagaaagaaaggagaaggagagaaagaagcgagaggaagaagagaagaagatgaggtggtaccatgacaaacgatgataaaacaaacgggaagaatatggaagaatataaagcgactcctgtatctgatgcagggggcgaaatgggccggacgaatgcagatgaagatgtcaggcttgatatcacggttattctggaccggtcaggttccatggatcccatctgtgatgacgctattggatcatttaatgcatttcttaaagccaggaaggatagcaatccaaattcactcatgacagttgtgctctttgatgatgagtaccttgtcagagaagtgggtgtgccaattcaagcagttcaaccattgaatgaccggacatatgttccacgggggaacactgctctttttgatgctatcggaaagacaataaggacgattgaggagcgaacacatgaggatgaagaggtgatggttgccatacttaccgacgggcaggagaatgcatcggttgagtatactctggaacaaatccgatccctcattatagagaaagaagcaaaagactgggactttgtgtatctctcagcagatccctcggcttttgatgatgggaaagctatgggatttcaggcatccaagatggcaatgtacaaaaaagaagagatgcatgaggcatatgctcacatggatgagatgcttgcaatgaaattatccaaggccagggatattaaaattatgaaacgacgaatgaggggaaatgtggaagaggataaaatgtaccagtaggggagaggaggtacagggtaattcctctaaaattctccttctagtttaaaatttaatcaattccgatgggaatactactattcagcatgacaaggatattctcttctctattatttgttaaatcattattctccatttgaaaaattgtattgagatggtaatggagcgaaaaaacgacataatataaagaaactgacataatcaaatattacggatacgaattcatagtatgtttcagcaatgaaaattcagttaagacctgaccttgaaagatacgatctcattttaagattaatagtgcatttagtataattgagggcaaaagttatactcatcacaagaggaaaagcttgagagtgatctttcctcaccattatatgaggataattcatgcttttccggtatctttatgcgaccggagaatggatagtagataatagcagaggttaggaaatcatgcccagagctttcaacaaggatatgaaaactgcaattattgccccaataggaacaagccccccggtcattactgcaggtattgacgcacttgatgaaccggtatctgatctagtgctcctcgcgacaaaggatgaacaggtattagccggctgtgatgtcgtaaaacttggacttaaatccagatacccccgaatcagggttcatgtagagctgcttccgtttgatgatatcagttcagatgttgaaaatctcacattcatggcaattgcagcacgtgtgattaagaaagaacgtgaaagttatgggtgtgagcgtattctgctcaatgtggccggcggaagaaagaacatgtgtatcactcttgcactcctggggcaacttcttaatgtggatggagtgtatcatattgtgaaccatgaggtaaaactcttcaatcaacacctggaacgaatgagaccgacgatgatgagattgttccgggctgaaaaagaagaggacaaaattatgatatatgcagataaccgggagatgtttgagtacatcctgtatcctccaaagaatgaatatgagttgatccgaattccaacacttccctatcctgtctcgtatatcagttccctcttaagccgggtggtttttgatccgtatatgttaaatgaagaggattgttctcttcttcttcatcatggaattcttgagcgtcaggggaataatctgtatatttccgattatggagcaaaatttttagatgtccttgttggaaaggggtaatgagactttgttgaggcgtaattctgccggctctccattcagtttttttgcctcgtccattgctgccttcaggtaggtatcagcaacgatgaggattttatccgcagagattttttccgcatgggcctttgcataatagtttttaccaatattttctatctgcatctgggtccggtataagaccattggaagtttatcaaggtatgccagccatgaattgagcatgactttcccctccggactgatgtgatatgaattcgccctggttactgctcctgaaagttcatcggcatattggatatttaaagtaagcatggctccattcagatcaccttctgatatttcattggataattgtgtatagatgtcttgtattgttcttccagtcgtgagaatatcagatgccagacgtttatcttcgaaaggtttttccgtttccactggtgtcacggactgattcagggtcggggttgtcgggattggcgttgagtttggtttttcctgatgtacgagcgatatggaaagaaataataagagacaggtcaggatgatcccaaccagtatacctgtaaaaaatgatttgagacatggatcattcataatttcagtactagttaatatccatcagtatttttattatttatgatatgtgataaacatgaggtgttgaccagtaatcaagagagatttacatattcctcatgactgtggatttacaaaatcggtgatggtccatttctatctgttcagaataaaatcaatatgtttatgtattggagaaaagtaatggctaatatgcttaaacttcataaaattcagggcggacttatactgggattactgcttttatttttatgtattcctgcatcagcagccatagatctgacgtcatcatctgtctttgattccgggggtttaacacctgcttttggcgaagagattcagacaacaattattatcaaatcaggtcctcatgacgttgaagacctgaaaattgtttttttagagatggatgggcttattgatcctctttcttttggaaaatcgctgtttccaatcgagacacaagctaatattacgctcgataataatgttcttttctgtgaccatctgaaagcaggagaggaactgaccataacgtttcatgtatatccgaagagtactcaaaagtcaatgattacccctgttcagatgcagatctcctatattcaacttggacaaaaaatatcagaacaaaaaacggttacaactgctatggaccagtctgcgtggcatactctgcaaaccacccggaccagtacaaataatactgggattcttcttattcttgccgctcttggaattgcgattgtgattatactcatcctcattgtgaagatgaaggacatgaatgtgcaggatacctcaaagaagatagtttcccgtgatgtgagtattctgaaagagataaaaagcagacttgacgggattgaaaacccatccaccagtattattgaactgcaacattatgtaaagtctgaactggataagattatgaataataaaattggaactgatttgcctgaagatggtagcagaaagatagaaaatccagataaaccaaagaagaccggggataaattctgagggatattatgagtgataaggatttatttgaggagtcaggtatcatcccaacccttgcaattggtgtcgggatggggggagtgagtgttgtcaaggagttcatctcttttgttgagaagaatggaatcattgataattaccggtttgttgcaattgattcaaatattgatgatctgaacaggatcatagagtttgcaccaaatacctcgaaaattgcgattaccgatcaccagtacgatgtgatgaatctgaaaaaaaattgtccatatctgcataaatgggtcgttatgcaaaagggaggtgctcttcaggagcgggtgtatggacgatttctgcttgatcttcacaaggaagagataacaaggacgattactgcccatatacatgatctctcaaatctctggaaagagaaggaaggtggcggtgagaagcggggtcacattgcaatctggattattcattctctgggtgggggaacaggtagtggatctttcccggctctcgccatctatctgcagaagatagtaaaggaaatcctgggtaataaaggaattactccgcatatctatggggttggtattcttccttccgggacaaatattaccgacatctcaactgcaacgttcacaaagagatattttgctaattcctttgctgctcttgaggaggttaaggttctggcagcagcatcagatgttgcccctgtaaccctgaaacttccgtttcatggtgaacctattcaggttacggaacggccttttgaacggtatttcctgttcggtattgatgaagagctgacgacgaagcttcggaaggagaagggggagatggttgatgattatctctcccatgcaaataagattattgtaactatgatgtttgctcttccccagtatccaaaaggtttggagaatctatggaaggatgttccaagtccttttgcctcttttggagaaagcgaactgaatattcctattcggttggtgaaatatcttgcaggggaaaatgatcttctcggtcctgttattgatgagaatgaatcggtgaaggcagaattgcgtaagctggtcattgatgcgatgaaagaatttttgcggaacttgaatgagtcatttcttgaggaccgggcgttagcagtgttccaggagtatcgtcttttgggtctggcttattttgtggggaaattgcagaatcagatcaataaacttcagattaatattcagtcagaatatgaggaagaactggatacctggtgggagacgcttagaagtgagagctggtcatgtgaccagattgagcgggcaggggttgttggattagaagagaaacataatctgattgttgagctttttaattcccgaattgaggaacttgtgagaaaattagactcacttctggtcagtcctttgaaaaagccggatcttcgggaacgaaaggagaagattgagaagattttgcatgatcttgaagttttaaaggtaaaaactctgaaagtcagaacattaaagcaatatgttgatacgaagataggggagaaactttctcttcaaaaccgtgattcgaaggagaagatcctgggtgttgcatctatcgttacctttgcgaggaagaaggatgcataccgccagaatgtcttgaaaaaacggcttggtctgtctggaagcggtcgggttttaaatcctgctctttctgaagatattatgaacagcgtctctttagtgcgagatatcaatgttgcccatatgaagagtctggctgattatttccagactctaaagttttcacagaaagatgtggataaaattataaagaataggattgagcagtcccgtgaccggcacctttcggttgcaatcggttcagggggggagattcttacaaatcctcgcgaagaactatttattttatgtaatatgcttcatgagagtgcacttggagataatattgcatttgcatcaatgaaagtggtgaagataccaagtcagacatataatgatgagaaagttgagtttattgactatactctcaatctttcaattgaagatgtgaaagagtacaatattcgaaaagcagagtatgtgcagaataaattgaaagaaaaaaccgatattgccgggcctattggaaccatctttgcatacccggagtggttcccgaaagatcctcttgttcaggaggtctatctggatatcggttctgaatcttaaatgatccggatttctttttttcctgatatttgtatgagatatttgatgacatatggtataatggtgaattatgattaaacgggcacttttatttggtgggacagacgggcatggcattattatgactggtctttccgaacgggctttaaagggagaagggtttgaggtgattactgtatgttcgtatatccggccattaccggagaaggaacaggaatatgcagattatgggactcatataccatgttttttctggcagtatacgtttccctattatatgaagaattttgtttccgattattccattgttgttattgttgatattccctttcctgagcctgacaaccggtgcccgtctttatctgttgatcagattgttgaggagatgaaatcagcactcgagattgttccgagaattgtcctgattgatcatcataagaactcatttacgcattatggaaaggtttcacaggttggtgcggaggttgtaatatcttcatcagccatgtttactcattacgggaaaccggataagtttactcataaatgggggagatatggagcaatttgtgatagggatgatgctgttcttccggtaactgaagaggaagagatttttgctgcacgaatagatgctgcgaaaactgatattgaagggtgtcttaatgcaatacggcaggatgatttttcattttttaaccatttctctccggatattccaaagcctgatacggtgatggagtatgattcatttctgtatatccccagattagcggaagggtttggctataaacaattggatcaggcatgcaggcagtatagaaaggattatgctcttggagttagttatcagaaccctgataacccagtaatccttctaacgacgtattggaaatcagataacctaccggtggccctgttgcttggtatgaccagatttcgtgggcatgttactgctccgaatattgatttttctcatgagatggtcgacgatctcatctcgttgttatctcatccagataagggagagatcaaagaaagcggacagattctttctaatcagttctactcctatgttgcaaggtttttaaggcgggttgagattccgtactttctgaccctgcataaatgggggcatgtagagcatgttatcgcgaatgcacggacgcttgggtcactgtatggtctttcagatgaagaacagaaaatccttaactgggcctgccttctccatgatatcgggtatgggatcgatcgttcaatttgtccggattttgacgagatacaccgtcgccatcatgagttttcagaacagatggttcgttcatgggaaaaagaggggttgttttccgggtttttgaatcatgatgaggtgagtcttattgctgatatgtgtctgcgtcatcggaagaagatggaacttccaggcaaggagagagatcatctgtatattttgctcagggttgccgatgggatggataatgattaccgaagggctcagaaaaatgatgaagggacactctatagtgaattggataagcatttaaatgaagattccaggcgtgagtgggagagccatcaggcggttttagggctttctctgaatataagggatgatgttctgacttttgtaatgattgttcgtgaccgggaaaaggccttcgtgaaaattcaggatctggaacgtgagactgaaccattaaaacggtattataagattcggatagagattatagatattacagatgagtagagggagatgagatgacaaaattactttcttttgtcggtaccgggcagttatatgatacgatatatcgtctgaatggtgaggagtatcatacagctgtcgttcaggaggcgttatgccggtattataagcctgatgaggttgtgctgtttgtgacacgtgaggcacgaagcaggaatcttcccatcattgaggctgcgattccttctactccgattactattgtggatatccctgatgggaaatgcgaagatgagatctgggatatcttttcaatagtgaccgattcggtgcatgagaatgatgatattatctttgatatcacacacgggtttcgatccctgccgtttattgccctgctttcgattgcgtatttgagggaaataaaacccttttcactgtctggtgtggtgtatggcgcgtttgaggctcgtgaaacgattcacctggaatccgggaaagagatttctcgggcaccggtctttgatctgaccagatttgtgagtatttttgactggatggcaggggtcaggtcttttcttcatcatgccgatgccggggtacttgagcagatggttaaccagatctctgatgaggagttttcacaaatccagagcagaaaagggacaaaaccgcttatggacctgttagggccgatgtcaacgtatgccgcgtctgtacggctgtcacgaccggtcgaggcgatgaagactgcatatagtattcaggaacggttcgaagctgctactggagcaattaaaaagcatactccggttctgacgccgcttttatcaaagatatcagagatagaacatttcgcgttgccggagcctaatatcctgaccgatgctgtgattcaaaagcagcgtgatcttattcaggttcagcttgagatggggctgtatcagcaggcggtcacgctgggacgggaatggatggtaacggtactgctctttgctgcaggggccggggaagaatggctgaaaaaagagacccgaaatgaagcggagaattcactctctggtgcagagaaggtactgagtacgcagtctaaagcccagtctcttcgtaatgataaggagaaacccaggttcctggactggttctgtagtcatgtttcctggaaggagatgaccggaatttggagcaggacctcgcagatgaggaatgaactggcccattgcgggatgaacccagaaagcctcaaagtccggcaactgcaaaaaaaggttgataaatttcctgacgttcttgataagttttatgctctgatgatgggattaccgggttaattcataatttgctgagttcctgatatacattttcgagttctcctggtattgcgagtacgttattttcaagtgtttttgcatctttcctgatttctctcatgccacaatgtgccagatcatttctcacccggctaattttctgccaggtgttagcgattttttcccatccggtgatttgttccagccttcttaccattggtgaggacttataattttttcgtttcttcctgatggtcagagcatggagtgcttcttcagcatcggttctgacggtttctttaagccaggaggagaagagtccctggtggcagatgactgcagagaccatccattccctggcgagttcggcggcctgcagatatagtcccttttccacctggtatgatatgattgccagctgggattcaagggtgctccaggagggagaggaggatcgggtttgtgcaaacgggggcatctcatttattttttctaggaccggatttaaggcagggaagtctgcatgtatcttatttctgacattggcaaggtgtttcatgacttcgataccggaatttgcggcttcgatggggcgtgcaagctgtatgccagcggtgaactggcggagagaatcggcaagatgagtaagggtttcatatggatccgtatcaggatagggggatgaaatggatccaggaatccgggatgcagtcaccatggcctgcatgccccttgcatcagcaaaggagacaaaggatctgacagccatcatccagtcaacaagggtgatgaatgaggtgagatctgatatgggtgatattctacgggtctgaccggtgtgatcacagaaatcttcacctgcttcgtacgctccatacacgactccccaaagggttgcaccggttacttccctgatgtatagggcggtgaggaatgcaaggaagggcataaaccggtacgcatgggttatgtcaagaaggatttcatcatctgggccaactgcatgagatattttatcaaatatttcccagagttcagattccgtccgaccatccgggatgtcaatgagggtgtgtggatgttctgagaggctggtaatgacggtggagagattatttgttttggcttttccggtgacaaagagggttatcatgtcaggatggtagaactctgccagtgccttttgtataacggtagtatcgcatagagatccgttaagggtgtatctggctggttttaattctccggttccgacaaaactgagacatttccgcattgagagaccacaggatacatcttggctttttaagtcttaaatgatatcgagtgccaggagttcgtcagtttcggcatcttcacgacaggtgatacagatttgaggccagtcggattcgtcctcgtcttcgaattcttctccgcaaatttcacagatgaacatatcagtgcataatattccaggaattttatcaaggtcgggttattttttggcaatgctattcgacaggtaagtctcatattttcttcaggtgacttgcaactacattaccataatatattgaaatataattttcacgttgccatacccttctattttcgggtcacttgcaacgcagaccgcgacgaggcctggggcagactggaaagttgccatacccttctattttcgggtcacttgcaactatttctccttcaaaacgtttaatgtacttattcagttgccatacccttctattttcgggtcacttgcaacagcagatgacatagtaaacagaatcactgaactggttgccatacccttctattttcgggtcacttgcaacctattcccctgcacgattgagaaacccggcgcatagttgccatacccttctattttcgggtcacttgcaacgactcaagtgcaaagaaagcaatcatagaacttctgttgccatacccttctattttcgggtcacttgcaactttcatcccatgcaaacaggtgccgggcaatcagttgccatacccttctattttcgggtcacttgcaactatcagaattctggaaagccgtctctcaagagcgtgtggttgccatacccttctattttcgggtcacttgcaaccctgtcacgagatgacgtgtcagccatgaagtggttgccatacccttctattttcgggtcacttgcaactatcaattaacctatgttctactcttctgtatgtgttgccatacccttctattttcgggtcacttgcaacatgcgtgcccgcacgcctgcacgttgccaccttggttgccatacccttctattttcgggtcacttgcaactaacattgcattagaacaactctacgtggacatcgttgccatacccttctattttcgggtcacttgcaacaaatagcccgtcgccaggcgatggtatcacgaatgttgccatacccttctattttcgggtcacttgcaactaaccgatttcaggttacctttatagcatataacaagttgccatacccttctattttcgggtcacttgcaacatctcgaattacaaggtagacccatggggtctatgttgccatacccttctattttcgggtcacttgcaacccaatacgttggtcacgtaaagtacggatgtgaggttgccatacccttctattttcgggtcacttgcaactactttttccgtaaaggagctgcttacagaactggttgccatacccttctattttcgggtcacttgcaacaactaaaagagggcccccctaaaatctcttaaagttgccatacccttctattttcgggtcacttgcaacaatctatagggaaggtaaatctttaccagatactgttgccatacccttctattttcgggtcacttgcaacaaggtttccatcctcatagaatggaaacaagcgggttgccatacccttctattttcgggtcacttgcaacagatgaggtattggtgcttaaagggcacccgcttgttgccatacccttctattttcgggtcacttgcaacaggaagagtcgaacaacaaatttcaaaaaattgtaagttgccatacccttctattttcgggtcacttgcaactgtggtgacttgagtggcaccactattagccgcaagttgccatacccttctattttcgggtcacttgcaacgggggcagagttgcagatgttgatattcacgctggttgccatacccttctattttcgggtcacttgcaacgaggacttgagttgtcccctgtgcacagtcgaagttgccatacccttctattttcgggtcacttgcaacaacttctccagcttgtgctctatctctatatgatggttgccatacccttctattttcgggtcacttgcaactctcaaatgtagtgccccttcccacaagatttattgttgccatacccttctattttcgggtcacttgcaactgtaccgtccttccatgctgcaaatcattaacaggttgccatacccttctattttcgggtcacttgcaactcataaggttgatctcatgttctaaccaggttacgttgccatacccttctattttcgggtcacttgcaacaccccaaaattccatctgaacgataaatattttttcgttgccatacccttctattttcgggtcacttgcaaccgtgtaacctaattatcagtcattcagtctcacattgttgccatacccttctattttcgggtcacttgcaactaaaaatcggtagtgccctgttagcaagctggtaatactaagtgcaaataaagtattaaattttatgtactaaaaattaatataagtttagatataattattttcatggttggaaaacgtggtcctatattgattacgtgtcaaaatccggattgtacttattttcaaattgaagatggaaagaatattactaaaaatgggcataattctgcaggcaatcaacagtactattgccatcactgtcgacgtttttttattgaaactaaaaatactcctctgtatgattctcgtttaccacgaactgctgttctcataattgcgaaacactcgactgaaaaaacttcaattcgaggagtatctcgagttaccggacaccatcgcgacactatatctcgatattatcacttaatcggtgaacatgctgaaaaactcaacgattattttattcatgacatttccgcgggggattgtgagatggatgaaatttgggagtttgttcaaaaaaaaacaagaatctcctaacaactgactctgaagaattaggtgattgttggtcctatacttgttttaaaagggattctggattatttttagcatttgaatctggaaaaagaaatattgatacttgtgcagatatgttagttcgattttttaaccgaatggaacttccaacgccagaaaacaaaatatcgatttttactgatggaaacgtccaatatagcatttgtttacctgaattatattgtgagccatgcttggattatggtcaggtgatcaaagtaaaagagaagaataaacttgtttatgtcattcgagagaaaattatgggaaatccagatagtaaagcaatctctacctcagtcattgagggctacaataataaaatcagacaacgattgagccgttttggaaggaaaactgcctctttttcaaaaaaactcaatagattcatttcagcgctaaatatctttcaatttgtgcataattttatcgaagtaaaaagtagtcacaagtctccagcaatgttagaaagtattactgatcatctttggaattggagtgagtttttaaactaccatgttcagttctaaaggaggccagtacctaaaaatcccataaaaacgaaaaagaaggttgtaagttgccatacccttctattttcgggtcacttgcaactgcaatactaccatatccaccaaatactctaagttgccatacccttctattttcgggtcacttgcaactttgtattatatcatcgagtaaaaaacttgaaacagttgccatacccttctattttcgggtcacttgcaacttaaatggtgaacagtataattgacgaaaaatgttgccatacccttctattttcgggtcacttgcaacccaccaaccgttatattccttatgattcatttttagttgccatacccttctattttcgggtcacttgcaactaaagaagcctaccgatacaggaggaaagataaagttgccatacccttctattttcgggtcacttgcaactgaaaaacactcccccgtcagaacccgccgttcggttgccatacccttctattttcgggtcacttgcaacaacgacagcctgttctcctgtatcactggtgatgatgttgccatacccttctattttcgggtcacttgcaaccgccacttttttcgcttagattggctcaaaacctatctctccatcccccgattttcaaagatcctacccggatcaattttgagccttcagtatttaaagaagtaggcataatatataaattttatgtttcgatctaagcccattccggcctccgttaggatattttttacccggatcgattttgagccttgagtttataaagaactgggtagtccctctaacaggccctgaaaaacccttcttttagatcacctcaaactgccggttcaccttgggtaactcttcatgaacgagaagagcacgctccatacaggcattgcagacttcaatcaccagtatcttaatactaggctttgtaaattcccgtttgattcgtgcattcatctgatgaagtctcgtttccgtaaggcttcccatgaacacactgtactgcacccggatcagtccataatattccaggacttttatcaccttgttccggtcctttgtcttctccacgtcataacagacgatcagatgtttcactgtcatgtccggtaccggtacggaacatactcatccccttcagtcagtgcttttccaatcctttccgcctgccttttgaaaatatcctgaaatgtttgttcttcatattttactttcccatgtattcgagtaagtacagcagctgcatacttcttctttgccatcgttccgatcatacaaccaccctcatctggataggtaaaatcatcaggtgtggccatatgtttagcaagaaatgtcacaacggtccggtcaaccactggttgtctgaactcctcaaccagatcgtataccagtgcctcctgctttttatatgtttcatgatatgccccataataaggagaataccctgacagcaccagtgcctgcctggcctgaatatagagcatcccgtatccgtaactgagtaaactgttcactggatcagttgcaggattctgcgacctgcccaaaaaaccccattcctcatcaaaagccaatgaaaaaccctgaaaatacgcatgagcacctgatccttctacgccccggagactatcaagactctgacattcgagagccttatcctgtgcatcctcaacaagtctaatctctcgtgagagatcaaatccacggatacgttcaagatttgaaagaagcgttcgtttattctccagtgccccagtgcatatcgaccgggcaatctcaagtcttctctcctccggagcagaagcctgagcctcatattgttcaatgagagcagatcttccaagagggagaaaatgtccaaaaggatttcctagtccgtccatgagtgcaatggccccaccatgagaggttaccagacgaaccgcagcagtggaaattgagtgatcgcccgctattgccagcaggtcaagaccaagtggtgagagggtcctgggaggttcagcagtatcactatccttccccgtttcaatcgtcaacacatccccacgcttgcgaattcgatagccggcacctgtaatcagcaccgaattcatacggaggtattctgccgctgaaaaaaattaatctttgcatgaacattcatatcagtgaggactgtaggagcatcaggttcaaatcgtattattaatacctgatgagggtcgaaatgaagttataaacctaaaggattgcttatggtggaataacccatgcaattttataataaggagatatccttcattcatacagcagaccttcatctggcaagcccgttttcaggaatatctgaaaaaaaccgttctctagctgattttcttcaccgttccatatttcagtcatttgacgccatcattgatctgtgtattgcaaaggaagtcgatgtactcctcatagcaggagatgtctttgacagcagggaaaaaaacctccgtgcactgcatcattttatcagggggcttgcccgtttgaaagaacaccatatccaggttatcatcgcaaccggcaaccatgatcctttgagaccaggaccgggagaatctgccatatgggatgatatcctaaatatcgcaggagataacccgccatttttcctggtacagtctgacatgtgtgaatcgatagatatcagtcacaacaataaaatcgtggcacgagtatgcggaagaagttatgcaagcgctgagacatttgataatcctgtcacgaatttcccccgaaaacatgatacatccattccatggatagggctggttcattgtaccatcgggtcacctggtgatcatattccctatgcaccccttggaataacagatctaaccggccttggatatgattactgggcacttggccatatccatgccggatatacggtgcaagagaaagacccggttatcatctatcctggaaatattcaggggaggaactggcgggagaccggggcaaggggctgcatttatgggaaaatacatactgatggaaccgtgcatacagaatttttagagactgctccggtcaggtttgaaacaagggagatctctattcagggaatggaacaggaagatgaattaaatactgccatagaaaaggttatcaatacatcatcggcaggcaaggggaaaacatccattattctctcaataatccttaccggtagtggaaaactccaccaaagcctagtacaaacagacctgttaaacgagatactccagacataccaggaatatacgcctcacccgccattttgttatctttccaccgtgattgacgcgacgacaggaacaatggaccgggatgcaatcagaggaaaaggggatatctttgatgagatatgcaaaagtgcagaatctcttgctgcagaaccggactgtgcgaaaacccgggagatactcgctcccctcttccatcaccatacattacgtcagattttaggagagatgtcagaagaggagataaaactcctgatacaaaaggctgaagatcaccttcttttaagtctgggtgcagcagatgaagattgaagaacttgacatcaaagggtttggcaccctcattaaccggaaattttcatttcccagaaccggggtgaccatccttaccggcaaaaatgaagccgggaagactacatttttggaatttgtcagaagaatgctctttggatttcccaccggaagagttgcttcaaaagagtatgaacccattacaggtttggtgaaaggaggagaattatctgtcatatttcaagacggcacaagatataccatccaccgggtaaaagcttcaaatcggaaaattcaacagtatcttctgctggaagatggaacatcagcctcgatagaagatctggatgctcatatgggaaagatcagaaaagacttttacaaccgaatatttgccctaacgcaccttgatctctggaacgggggtactctggtgaatgacaactcggtaaaagatttccttatcggcggacttctgagcatcaaaaagtcgaatcctcatgtcatcgctgaaaattgtctcaaagaagcgaataaacttttcctccaaagaggcagcgcacctattatcaatgctctcattgctgaaataaaaaagataaatagaaaaattcgtgagatagaggcaaaaactgaagagtatcatgacaagagtaaaaaacttgaagaacttcagcaggagaagaaaagactggaggaacaagagttaatcgttcaaaaagaactctcccattaccggatgctctccgaggcgcgggattcctgggtcaccattgcacaaaagaagaatgaactcaacgaaataatcatacctgataccttctcaatagatcaggatcgacgaattgaggaactgcaggaaaaaaagagagagattgataaggaactaaaacgacagatagagaaatatgatgatctgaatttacaaatcgaacagattatatcgaatgaagcaattctgtcgaaagaatcagagatcatacaaataaatcgtctctatcagcagtacatagccgatataggaaaattgcccaccatcaggtcaaaactatccgggaaaaggcgtgatctggacatcgctctcgaaggtctcggcccattctggactgaagagaaattggataccatcattcttacttctgagataaaaaatgccctgtttaccgccaaagtaaccctggaaaattctgaacgggaactattacagataaataatcatataaagagtcttgaagaggagatttttcgaatcaaacaggatattccgattcctgacaaagaaaaacttaccgcagcggattcaatcatcgagataaagaaaaccatatctgaaattcaatctctcgaacaggaagcgaccctcctctcaagacaggttgaggaagcacagagaaggtatgacaattccctctcataccttgtgaatgaaggcctagaaatctctccagcgtttacaaccaccttccaatacgatgccgtcagttcgtcggttcgtgcctttgaagaagagatacaaaatcatgaagaacaactacgggcatataagacagcagatactctgttagaacgggatctcaatcagtgcagtaatgatcaaaaggagacggaggccacaatagaatcgctgggaaaaatatacccggtcgatgcattaaaaagacggcaaaaagccctctatgaacttaaagaacttctcaatcgaagagataaacgaagagaatccggaatttctcccggttttgctagtaattttacaatattcgccctcttgttcataggtagttttctctgtattactgcaggattcatctccggccagtttatttttattggtgttggcattggtatccttctcatttcaggtgtgctatatctgaacgacaggaatacccaaaatatacgggcagaagaagatgacaagcttgagcaggagattgaaacctattccaaaagactcaatattaaaatcctaaagtcggatgagatagaccggataattagccagactgaactactatccgatagatcacgacaggcagaagcattacagattactctgtctcagattctgaaaagaaaagccaagtcagaagaaaatattcaatatctggaaggaaagctgcaagaagcgaaacgggaactcgatatcactttacagaagtggcatgcttttcttgtagaaatgctttcccctggtttggcagagagaaatccatctccccgtaatgtatactcacttctttccatgatacaggtcgtatccagagaatcatctgaaatcaaccggattaatcaggagatagccaggatacaaaataaaaaacaagttgcattggccaaatgtcaggagatgctgactccactcatcataattttttcaattgaaaaacttcctgccgacattaccgagctttcagcatctatcgatctcataaccgagcaggtacagacagaactcaataaacaagagagagccaacactcttcttgaggaaattaaaagacgaaaacagaaaattgatcaggcacaccaatatcacacctcaatctctgaccgtattgtacaagaacgggaaaacttcaataaaatattgactcggtcaggacttcctgcagaatgcaacccagaccgtctagaaagtctaattcaggaagttctggccgcccggacacagtatacagggttgaaagagacgcagcacgagctgaatgaattagaaaaacagattcggtcatacgaggagcaggtgtattctcttcgtcaacttatcgaagaatcaaccaaagatagtacgattaatttcctcactgaacggctagtatcactactttcaaatgagaaagatattgtacgcaaaagagattccatgatcgagaggataaaagggtgtaaagagaggatcgataatcagaagaaagaacgggaattggttcaaatggaggaggaatctctcctatccgaatcaggtgttccagattatgactcatattgtgaataccgttccatgttgcagagaaaaaagaatgttattcaggagatagaccaggaaatagcaataataaacaggatttgtggagatcctcaaggatataatcaagtctcccatgagctgtcattgcagtcaaaagatgaggttatggctgcaattgaaacaggttcatccagagtgagtaaactaagggagcagataagtattatagacagagagataggaagcatcggaaccgagatagagatactcaaacagtcagaagagcataacaggctcctacttgagagaaatattattcatacgtcaattcatgagtacgcacagaaatgggcggtccagaccttggctgcggaaatgctcaggcagtctcttgagaagtttgagagagagaagcaacctgccgtcgtttcaaaggcgacagaatacttccgtatgatgacaaacggtgcatacagccggattattcttccgatatccggagacgagtttgaggttatcatggataacagtatcatgaaaggtcctgatattctgagtcaggggactgctgaacaactgtatatttcccttcgtcttgcctacgcaactgaatactgcctgcaaaatgaacccatgcctgtggtgcttgatgatattcttatcaactgtgatgaggatcgacatgcacgagcaattcgtgcaatcggttcggttgcagaacatacccaggttatctattgtacctgccataataaaaccgtggaacaattctccgatattctcgatgatgtccatgttatcgatcttgattcaccagattcagtataccagaggagagaagatcctgatggcatgacgatagagggagagggatatttcgtgctttgagtatacatatcaatccgggaatatcggtaaaaaagctgaggtatgatctgatgatcttatccttgatcgcagatggctttgaaggcacaatcaatacaatggtttgaactcggattgcgggggaatttttcgtattcataggtgctgttcattattctgaactcatcggttatgagtgcccagatatcatcaagatcggtttcagtaaagagataaggatggatagagccggttgaaagaaaattcagttcactccggatatcacgtgggtccttctggaaatattcactggcccagaggacatacactcccatttgtaacctgttgatcggtgaatcttccatctctgcacctgtcttccagtcggtgatgatcaaaattcctccaggatcctggctgatgtaatctaccttcagtaatacttttgtggaatcgaccagaactttgtcgaaggtttcatgcctgatatagatgttacctttgatatgtggccagagatccgaaaaaaacgtatgtatttgagtgacaccggtctccctgatctggtcaaagaaggtctcatctggtgctccgttgtagaattccgcaatggttgttcgtgaggtattctcgtacatctgaacctttttcagatactgagatatcatagcttcctgatctggttctcttcctagattgtgtttgttcatctggtcttcaagaatctcatggataatcctgccctggagagcatatttaggagtgagagatttgagcatacttatttttccaacatccagattaccaggatcgagaaggtacggggcaatattctgataccagaattttcttttgcagcgatgccagagctcatatttcgtgtgtgaccaggagttgttattgtaaaaccagtcttttaattttgtcattggatttcaccggtgtattggattaacgtttaatctgggtggtatgcaatgtaatattttttttaatttaatagaacagggttttattcagatttcattaaaatggtggaatatacttctaatttcgggtctcttgcaacatcgtaatgactgcgcgaacgatcttatgagttagttgccatacccttctattttcgggtcacttgcaactggtacttgttcaacccaataacgggtatggtgggttgccatacccttctattttcgggacacttgcaacctacccaatattaacctcatacatctgtataccagttgccatacccttctattttcgggtcacttgcaactatgtagatcattatggtgatatatcgagtgtaagttgccatacccttctattttagggtcacttgcaacaagaaaaccccacattaaacatttacatagatgtagttgccatacccttctattttcgggtcacttgcaacattttagggtgacttgtaacttacaaaggtcagtggttgccatacccttctattttcgggtcacttgcaacagggtaggtatggcacattatggaccgattatagttgccatacccttctattttcgggtcacttgcaacacgtaaggatgagtgattatggtacggatacagagttgccatacccttctattttcgggtcacttgcaacattagatagagccacattacatgaggtctattatgttgccatacccttctattttcgggtcacttgcaacagggaatgttcgagaaatgaaatagaaacaacgtcgttgccatacccttctattttcgggtcacttgcaactaacatgcttgacaaaatagtggaatgatttcctggttgccatacccttctattttcgggtcacttgcaactgaactcatggagcttatccgatttctggataagttgccatacccttctattttcgggtcacttgcaaccaggtgctgcacagggcaactggtggtatcaggagttgccatacccttctattttcgggtcacttgcaacgttaatgatacgttctgcgatttgtgcggtaaagttgccatacccttctattttcgggtcacttgcaactgtgtactcgcgtttccatttgccgtctgtcccggttgccatacccttctattttcgggtcacttgcaacataatggatcatgttatgttcccgcctttcatggttgccatacccttctattttcgggtcacttgcaacctcaaaataacccataatgagatctttgattctggttgccatacccttctattttcgggtcacttgcaacataatggatcatgttatgttcccgcctttcatggttgccatacccttctattttcgggtcacttgcaacctcaaaataacccataatgagatctttgattctggttgccatacccttctattttcgggtcacttgcaacgaactggcagaataatgatccagccccagtatgtgttgccatacccttctattttcgggtcacttgcaacatctcactctcttataagtgagatgaatgaggatgagttgccatacccttctattttcgggtcacttgcaacaagagtctaatgagaagtataaaaaaattgtaaagttgccatacccttctattttcgggtcacttgcaaccaggtgcacaacctgatggaagaacagagggaaagttgccatacccttctattttcgggtcacttgcaacaggttgctgcaggtgttatagatctccctgatgtagttgccatacccttctattttcgggtcacttgcaacctgcctccgttggtgctgcaaggccctgcatgaggttgttgccatacccttctattttcgggtcacttgcaactacattctgcttttaggttggaaaggggcttccaagttgccatacccttctattttcgggtcacttgcaactatatcacactaaagtaaaaaacagatgaaatcaggttgccatacccttctattttcgggtcacttgcaacagccacacgcggtcctatcctgtaacctgataacgttgccatacccttctattttcgggtcacttgcaaccgtaagactgcgtaaacatgacgtaactatatccgtgttgccatacccttctattttcgggtcacttgcaacttacacttgacgagattgaagccgctaaggacttgttgccatacccttctattttcgggtcacttgcaacgaaataccacaaaggagcgtggttagatgatgccccgttgccatacccttctattttcgggtcacttgcaactttaaagcgcgccgaaattgaggcgcagtataagagttgccatacccttctattttcgggtcacttgcaactattaaagatgaaataaaaattctattgtattaagttgccatacccttctattttcgggtcacttgcaacattctagagggcttctgattatcctcaaagcatgttgccatacccttctattttcgggtcacttgcaactgcgtatgacaagttaaccttattaaacgctaaggttgccatacccttctattttcgggtcacttgcaacaaatcagatactagaataactatatggtaaatatcgttgccatacccttctattttcgggtcacttgcaaccccgattgagctcgtacaagcgggcgcgggcgtgttgccatacccttctattttcgggtcacttgcaaccgccacttttttcgcttagattggctcaaaacccatctttccatcccccgattttcagggaacctacctggatcgattttgagctttcagtatttaaagaagtaggcataatatataaatgtaatggttcaatttacgcccaaatcggccttcgttcagaatatttttacccggatcgatctcgaacctttagtttataaagaactgggcaacccctctaaaagggcccaattttttctcctttttttatgataatagataactcatatctcctgaaaaaaggggatacttattctgcaaggaacttttttgctgaaaaccggttcaccgattctacccgaattttaaccctgtttttcggactcccctgattatatttcgaaatcccggcactcgtattcccggtgatctgaatttccttatcaaaaaactgagtaatatgctccatttcattttgagtcatattatcaaagaccatatacatcatgagcgctgatcgcttcggtatatactcattcccaattccttttttaccagcataccaggcatctgatacgatgagccggccccgttggtttaatcctccaaaaatggaatcgatgatttttttatcggtttctctctgttcaagcttgtgccgtaagaaccctttaatcgtcgaaccgggaataaccggcccaagcccgtttgtgaccgtaggctcatcaagccctttcatcgaaaaatcagttatacaggtaacaatcagcgtagcgacaacatgtccgtcatcaaaccggttaaccggttctgagaatgctttccagtaccgatcaaaccctctgtcgctatcaggtgagctgtttatcccggcaagatatcgtttcgcagcagataaacaatcttttcctgaaaccttatccctggatataactccatcctgcagagataacttcgtaagagtgacacctttcattgaacaaaacccgtgacccctcgtagaaccgccgcccagatgtgcccgaaaataattaaactctcgaagaacgagcatcatgagccctgcctcttcgtcagtcccgttatcaagatcaatatgaaaccgaaattcagtacctgcagataccgactcttccggtcgcatcagtccttttccaccaggtctgggactaccaaagtgcggttgttcccgaagatatccctgccagtcctccttggttcggcactcatcggtcaggtgtgaatccctaattctcacctttgcacccccgttcatcgaaccaaacatacggcaggaaatacaggtgtcatttccgcaaagaaccattccttcttttttattcccgacactgacacagcactttgagtcatcaaatgtccttaccagacgctcaagtgtactgcgaaggatccctttcaggctgcttcctggaatatatggctcaaatacgcctgaacctgcatcaaaacactcaattacaggagcaggagagagcgaatacatcgccgcattctgacccccgccaatccgcatcggtgtcttcagttcgatagtcccttcaatctcgtaccggtttgaaaaccggtctaacgaatccatacgatcctcccctactccttcttcccggcgacacaggttctccaggcagctaatgcctgactgacaaacgcatcatactggggagttccaaatccataggttgtaccggaataattcccattcagataatcattcgctgagatcaccgaaatctctttgatcctgacctcaacctccccatatccccgggagaccccatgacccatcgtccctgcacaggcattgaaaaactctaccagggagagaagcccaccaagacgggcataatcttgtccatacaatgaacaattctctagcattacataaccggaaaaaaccgtgccctttggcaccgcctcaagatcgtacttactgcctggtttagcctttcttgattttctatcaattgcaaccccgtctctgataacggtaaacttttcctttgcagttgcatcccggatccgggcaggtgatgaattccccccactcccgaagatctgacagacaagacagggatccactgctttatctcttttttctgggtgttccttcagccatcgcgatgaataacacacatccggaatcgtgcagacctcaatggagcatcctcgcaaaagccgttcaagttcagtccgaagcacccccttgatactactcccgggaattattggaaaatcctcactattcctaagcactggaagatcaacatcagccggcccagatgatccgtgacctccgatatgcagatcagacttcgtcacaatatcccaggagatcaccgccctgttctcaaacgatgaaaacatcagtacctccccctctgggaatatccgcctctatcctgattcctctgcctgttctgatcaccactctgatgatatcccccttcattcttcacccatttctgaatctgtgaaaacacctgatcaacctcatgatcagcaccaacaactttgagttctgcttcaagcatcttcctgatagtatcctgcgactttaactcacccatggcagtgagaatcgcacaaactgcatcggcattccagtttgcatacccgatcagatacttgagctgctccctcacccgctcaggctcaccaccggatctgttcaattcatccacctgttccattagtttgttcatgaacgggagcatctgttccggtttcgttcctgcatctttccggggcagaaaatacgcggcactcttgacaaaatgggtgatagacgctgctgcatcatccatctgacgaagagcttcagggagagttttgaatttactccgtgaatcaataacaaacttatcatccttctttattggcttgggcataagcaccgtaagctcatatgacatgagcactatcttctttagttcatcagcattcatctgcatctctcatctcctccccgaaactttgcaactttgttgaaacttcggctttggtatcttttcaagaactgcatccgggttcctgacctgctcggcacgaagaatctggcgtatctttgattcatccccacgaagttgttcaataattctgatattccagagcaggtactggacaaatctcatcctatctcgggcagaaagatctttcattgccgaaataacttcagatccgaccttcttatggatccccttgcgtattttcatttcatctatcacttttggatcatttccaccccttccatcagagggctgaggcgagtaccgatcctgctgctccttgattatatgctcaaaccttgatgatctggcctgttcgaaaaagaacctcacctgaccggttgaataacactcaatctcttttcctttccggatcattgctgaagcggcaatctcccaggccttctgattcatatcaatcatatccatcagatcacccctgagacaaacatctcaccataccctgaactttgcatatcaccgattccaaacacctccaaagccgcaagagacgacggagaacccgtgaccatgatgcaactccccggaccggtagcaggaacaatctcatccaccatatttccattcttcagcgaccagcccctgacaaccgaccgggtaatatacggactgggatcagaacctggagcgatatctcctttataacctcttgattccaatcgtttattaatcgcttcgaaaaacgacctgtcaagcccaatcgtcgagttggcccctgatcgcaggatacagggagcattcagaatgagaagatattcatccccttttgaaaactctgacgaccgggatgcaatatgctcatcatctgaaacctgcgaatccacggaaatatcaaccagcccatacccccgtgatcgaaaacctccaagcccacaggcatacgaagcatcattcaaaatatgaaccacatcatcagcaactgtatcctctgcaagcatcacaaacccaaaaggaacccccggttcgattccttccacatggtacggtgaaagttgccagccacttcccatacttgtatgaccatccctggtaatcggacactttgtctccagtcttttcggaactggatcaggctgtaccagttttctctcggaaaaagatttaatcccaacgagaccggtatgtttcttcccttcctgcagacacagtcttccatctaccatttgagtgcattcattctcatcattctcgataagactgccacattttttgcaccaacgactcttaagaggggcataaacagagcgttttttatctgaaagaggatatccattcctgaaaaagaggtgcatcttttcaggttcatgatcctctgccagaccacatgcatcaaatagatcccggtaattctgatacaggtaccagccgatcataccccggatggtccgccccggaacatatgaaagcgtctgagaaaaggtccctcttgcccgaccatttccaaaatggagtggtgagactgatgttatcgttcccttcatcacctgcatctatttacacctccgaaattacagtcccatcagactttttaatttcaccaattttcagagcgccaaacccccgtgatcggttcttcccaagcccataacaggccatagtatgcagactagccaggaaaacccgtttttcttcatcagtcagacctgtccttataataatatctcccgtaaaaatcgtacctgaaggaatggcctcttcagaatagagagcatgttcctctttaacctggaattcacggttgatcatcacatgactccttctgagaatattcacttcctctttccctttggacggataaaaatccaaaaaacgtaactttccttcacgaaaaccgcctccgccgtcgatattgggaacaccaaagagtgagcagacaggacatccatatcctcctgccttcacctcatcacataccataatttcatgatcagtagaataaggattgccggtaataaaacacgatatccctgcagaacccttcataatccgttctgcttcacatcgcatcacccctttcaggtgggttgcaggaatatagggaatgctgttccctttacggtcctgatttcgggcaatctgaataaaagaacccatattattcccggttgtatgaaatggagagataaaacagagatcaatcgtccatatttccatcattcttcacctcttgtatgccagagaaggggaacaaccatcttgaccgcaccatggatattagtcccataatcttcccgtccaggactattcaccacgtctgccatcaccctggcagcttcaattctctcccttccaccctgttgcttccgaagagccgatgcataattgtattttataaagttcagtttctcaaaaaccgtgtcaccacaggtaatcagatcacgaacccctgaacggttatcagaatcaagaccgtcatgaatgatcttcatcagcatatccatctcattcttatcatcaggaagcacatagcaggcataatctgaagaaggcatagctccctgcaccgcagtaaatgcgacagctccggcaggaaggcggataagattcaactcatctgtagaactcctcttcctgaatgcctctttggcctttgattccatggatcgtgcccgatcaagcaggaaatagatagggaatttattatccgcaatagcaatgccacaggaaattgtaaccgtatggtactgatacgtgtcatactgagaaccctttgtcagactattttgaaacgaaaatgcctgagccacccgggtgatcagttcctgacagaatatcagggcagctcttgcattcatgataatcagaagatcgtctcccccgtcataaatgatatcaaacccacagctggttccaggaaacttctctccattctcttttgatttagggttatagagtagtaatctctgtcttggatcctttttattctgatccgctgccatcaaatcctcaagtgtctttccgacaacacccataaaacgacgagaaaactgctcactcttaaacgtatactcggcaggtgtcagagtatgagaaaaaagacgtcccatcatattcccatcaaccgcgataaccgcaatagaatctccgatatctgtcaattcatgaggatattggagattattatccttaatgaatgtaaatggccagggactaatcctgctggttcttcctttccttgcctcattgcgttgtattcgtccaaaattctcctttttagcacaaactgaacaatacctctctgtcttatcttcaatctgaagacttccggtaataagccggttcctgcaggcatcacagatctgatcttttttaggagggtgaatgatagagactgaatatgaatgttgttttatcatattaagttcattaacaacatctttcaggaaatcataaaatgaccctgcaagattttttaacggtatcgtacctgtcgtgactgcagcacgaagtaccccatcacttgcaaatgtgaccttctcttcagccttctcctttattttattcagccatgctgcatttgaaggacaaaaagccagaagattgccaccgtcagagaacaaaacagcctcatctcccagatcatcagcaataaatttcctgatatcctggagaacattcgaaacgatctcgctccctccacggagcatcggcaatttatccgcttccatgataaagtcctggatctgcattatatcaagagagaggtacccgattctgccacctggaaaagaccattccccaaggaattctccaggaccgccctgaactaccgaatctctgaagagtatccggtacttttcattctcattcttcggtctgactggaaccgttctgtcctgtttatatcccaataggatggtatgaggagtgatagagcaagcataatcgccgtcattacaattaatcttatgaggaaaaacgggatctttagaatataaaactaggtttccgtcttttacctctccagtaacctcatactgccgatctgcagaagaagagatcacatcaccggcatgaattagtttttcaagccttgttgttgtttctttggcatgatgtctccgagcaaggaggggaaggacagcatcaagaccaaaccgtgagacaaaggaaggatctacctttgatagtatctccctgacgatttcttcagtcaatgacacatgttcataaaacctaacatattttcgttcagaagaaaatgaacgaacctttcctaaatcatgaagtaatgaaccaatacgcacaagacccaccaggtcctcctttcgatattgaccgatctgatcagaagtcaggccatattcagaaagggaaccctgtataaactgttcatcatcaaggattttatcaacaagtaaacagaccgcaatagctgcagtattacgaagatgatgatatagtgaacagacagggagccttgtatccgaacagacagattgtaaaaaatcattctgttctaatactttacttatccggtttgcagcatcataaaggctttttgatccaaaagataaagcaatttcattgatgagcaaacctgtcttcccatcactttcatgaccatatgttacatcagaccggactttggtaaaccagtctataacaccaattttttcactcatattagacctcacatttgacaataaaaccaccaaaaccataggtactatgcttaccaatctgaagatgagaacccaaatgaaggattttccctgcttctggcgaaacagtggatgtatcatacagaatattcccgcaaatccctttaagggaaatcatcctgccatccatagatttatgagcaatctgaacggtttttatatcataatcaagaataggggcatgaaggttctttaaatcaatttcagtccgatagggatatgaatctcttgcataaaatttacatacacgattgtaagcacgaattgatgcagagagaatatgtgctaattcaggcagaatctccatcctctcattcttttcaagatataaaggagaaagagactgaatccttaccctgtcaccccattcgggaggagaaggatctaactttctgaccgatatttcttccactgaataatgatgacctttaaaatgaacggcattcgaatgatcatttatcctagaaacgatttctggaacaaattcctgcttatcaccatgcactttaatgaacccacggatcagatcacctgcccggaatgaaagaagagaatatggtttaatatcatttttttccttaaataccatattgtatgggcacgaagtcttatcaggacaattacgaacacagtctccatgctttgtacagtgcaaagatgcaccaagccatcctctgaagatcgttccggtataatcctctccgagctggggatgtgtcctgatatcaacagatattatcgtagtttgcatagacacctcatatatggataatttttttcggagtaattatgtctgtcgatttttgatttggaaataattctcgatacgcatggctctttatgaacaaaaaattctttttaacttttatattctatcatttattttttaagtactttaaatgaataaaataacaatttcataaggcaatcagggtaaggtatcccagcggttaattcgtgaacttgtaaattcaagggaagatttcaggataggctctactaccttgcttaatccaacctgaatcatcttacttcctttctcaaattgcgctgttcttcggtaaagatcggcgagcatgagttcaaaaaatcccgggtgattccagatataatctccattatttttacattttatcataaattcaatcgctttctctctacactttttacccagtctcatctcattcgtatcatcacatatccatgatgcagtcaggtatccaaaaaatgcagttttgttgtcttcaagtacctcggcacagtatgaatattgcaagtatcgtcgaattaaagctgatatttcgccattatttgcaatctgaagataattcccggattttacaatatcttttatcttcacatctgcaaaggtaatatcaggagcacagtatcgacatgtgggacattcctggatctgatacatcaaggtattccgtgccagagggactgaataaaatcccgaattaaaactgctgtttgaatttgaaaccaacagaacatcctgtaaactagacgatccacatactgcacaggtaacttctttgggatgatgattattcattctttcacctctattttcattcaagagaatatttacaggttttttagattcactccgccaggatttcgttagagaaatctcaccaagttggtttactctttaactatccatgactttgagagggaaacaaaatattacctgatattcctttagtgaaaggaacatgtatactgctcacataccgtgctgcaaatactgcttgagaggaatgagcaatacataaccgggcagatgagttctgcataatagatatcagagagtaagagtatataaattttctatgaaaaagcacataaaagtatacaaaaatacataaatatgtaaaaattttttatctatgatatggtcgaaaaccctagaatctacaatattataagaaaatatagcctaaatttagaaagaagattctcattaaaacaatgaaaagcgcaataaaagatagggtaaaagtgaataacatgaatcaaaaaatgtcttcaccaaaaatgaaaaaaaggtaaatctaaattattataaaattatatcattttcatctcatttctatgctaaaatggaatttaacatcctccggcatacaggtataggaataccgacgaaaatttatacactaccttatcacaatacattcaagtagatatcatacaaatacctataagacgatatgaaataatgacttcacagaggatcaataaaaatacaactacagaatctgaacccgataatggcccatatatagtgcagttatctccagaacgtaaagtgagaaactactttgaactaaaaaagggtaaattcttccggacagataccgttgccgagattcttgatattgaacctgaggtaattcgtgatctgataagaaaaaaggaactatccgcaataaaaatcgggaaatcatatagaattgcagaatcagaccttcaggaatttttacaagcgcgatatactatgaaaccaaaagaaaaaattgaacctgataaatagttggagagataattacaccattttgaattcatatgcctccacaaccaaatatccatgaaattaaaaaaagtttacgttttatcacaaatatccatccatataccctgctaccgtctcaaaaactcttctcctccctgaaggatttttaatttcatcattgtcatcattaccatactcatctctcgaaaaattgatatttccgaatctaacgatcagatcaccatacacatcttgagcgtcgtcactcttcagttccatgagcgttgccagaagacctaacctcccaattttttctgatggtaagcatctgattgcctgcctgaaatcggatgccgcatcttcgaaattaccaagaccgaatttcgccattccacgattattccaggatgcccatatatgaggtatcaatgaaacagccctatttcctaactccagggcttcctcatttttctccagacaggaaagggaccagcataaagcagaggatgcaaaaccggacaaaggattcagttcgactgctttttgaagaatcgtttccgcctccccgaacctattcaaattattcagaataagtcctttttcagttagtagtacaatattatcaggatcttcagccagcagttcgttgtagacaaccagtgcctcattaaaccgatcaggattctcctcaagatctccaagcatatgaaaagcatcggctataaaacgacgaatgactgaatctttcgtagtttgattgataatccatctatatgcctcaatagcgagcttatcaatcccgaaatccttaagcctggtcgctcgctcatgtatcagttcaacctgcctagtcagagaatcgccgccaagcctgaccaaatccgcaagtccggtctcaaggcagagagattcggatccctctttcaacagcatctgtacctgatcatcactgctcatatgatccgggatcagggagagctgatgcatcccttcagaataccgttccattttgaaaagaactccggcataggctatccggagcgaataatctaatggttcctgaaaaatctcaatttcaagcattcgtgcagctgtcagataatccccgatataagtccggagcgtcccattttctgcctgaaatacatgtgctgcatattctggaaccgatatatcctgctcatcgtttcctgaaagaattgcagcggcggatttcagatatctcacttccggtgtgtcaggaagaggtgctcgttgatcctgtagtattcctgctgcttcgtccggatttttggtctgaagaagagcttttacataggggagaaataaatcttgagaagcgccagtagtaagaatcccttctcgtgcagcaaataatgccgcagaataatcaccttcaagcatgaaagaacggataagaagagagtaatcaaggggtcttccccggttttccgtaagaatcagagatgctgctattgatgcatcatgaaatgaacctgcacggataagacatctgacatatacctcctgcaggttagcatcaggaatgacaggagggttttgagagaggaggagagtatatccctcccggtaccgttcctgttccaggagaattcgtgtatacatattcaatgcagcaggataatcaggatacttgtccagaattttctttccttccatttctgcgtcattgagacatcctgcagtcctgatagcaaggatccggattaaggcaaaatctggattatcatgcccttccagattatctgaagccaaaacagcatcaacatagcgacaggtaaatgaataaagcagaacaagcatggcatgatattcaggtatgtccggatgtgcatcgcttagagcttcaaagagtggaattgcagattccagaccatcctgtatcataccctgaaatgctagtgcgtcacctgaaaggttatctgtggttttaaaccacccttcctgttccatgccgaacagagtgtagaatataaatccacgatctctggctccagctgaacatatacactggaatgattcgatcacctttccctgctggtacaaagatgcatctttcaaatagattgctttccacgcttttggattatggtcagctttctctgcatagactattgcctgatcatatttaccgctgaaatgaagagcagtaatgaatgggatgagaaactccggattatcaggatcttcctcacatattctcttgtagattagaaaagcctcttcaaaccgcccggccataagcagttcttccccccgaagtcctggccatggatcactctcttctgctccaaagaatcctgttatgctctgcctgaaagtcatcccctcttcgattttaccaagatgcataagaacatctgctaaatccgatctagctcgcatgtcaagtggctgtacttcaactgcctttttcaaatacatgacagcatggtcaagatcaccaacagccctggctgatatgcctgctgcgtatgctacgagtgggcaatcaggatatgaatacatgataagatcactaaggtcctgggcttccttttcttctcctcttgtgagcagacataatattttcaaagcccggaatgtagcgagaaattcaccatattgttcatcatccgtatggaatcccaaaaccaggtcacagaatttttctgcctcttgagtgtcaccagtgaaaaacctgcatacatgcagagtaagggaggattctcctgctgaccctatcgacataacatcaaagtgggaaagggtcttaagggcagtataataatacccctggagcataagatttttcccgatataatcctgaattctcatatcaaacggaattactgattgaatctttcgaagcaccctgattgcttcacccggaagctgaagatcaaggaggattaaggatttataaaagagcaggaccgggtcatcaacccagacttttaggctttcatcagcaacagccatagcctcatcatataatccggatttttgcagatctgatatccggaataattgatattctctccagttctgaccctcctgggtaaatatatcctccatcttccccctccttatgatattagattgacggtttgggataaatacatttgtataaaaaaaggttcaaaaatatacataaagttataaattactatattaataacattacattgatttcataagcggaaatataaatacattatcaagtgattttcttgattcccgtaataaatctataataaattcctacctaatcccggaagaaacaatattggcccggtaacaataaaatcaaagagagggaatttttataaatgttgtaaataaggtaattcaaggatttttagtgtaatttattcaccttgaggattaaatatcccttaatctttcttctaactattcagaagaatcatatatcctttgtagatatccgacgcacaagtgaaatctagtattatttgcgtacaggtctcataggtggtccgaatactgatgataacagaagtcatccggaaatcatctatcaccaagaccattcttttaaagcatcagaaaatttagcgaagaccattatatgtctgtcaggtcatgtccatcttaaacttaaaagattctgaattatatggaagcacaggcaatccgacatcccctgatatcttccaaaataccaaccttgacatcatattcagcaatagacaggaacgtatcagtaatctcttcattcagatattcttcgccagaggtattacacactatggctgtgatctgtttgattaccacggtggtagattctcgttctaatgtgacagcaatattgcctggttcacaaattccatgtttacaaattccatgtttacaaattccatgtttacaaattgcacatttcatactctcctccggtattcactatccgatacctgagcatacggttcatatacaataataatatgaattatgggacctcgtgatctttcgatagatttcacatcagggcggttttttatatgttcaatcagatgcatcacaatatcccaagatcgaaattatccctttccaccatattttttataaataattcttctcggtcctatatcgatgaccagaacaaccagttcattatcataaagagacattattacccgatactctccgattctgtacttatatagtatttcagcacctttcggacgtttcatctcctcaatatgggctcggggattctcctttattgattcaaggatctggtatatccgtttaccaacttggtgatcaagattttttagtgcccgtttggcatgatttgaataatggagagtatacattagataaatcctaattccttcccaagatcctcatgagaagttgatttaccctctttatattcttctatgccttcttttatggctatttctgtctcttcatcgatataatcatcgctataaaattccagaaccctcgtgatcacctcgataggtttttcatcaggcctattttttaaatgttcaatcagatgcatcacggggtccgggatctccactgcttcactcattattatttcatcttccttctgacttcatcaacttttcaatagaaccaaaactatggattcttaatccccagatatgtgacttccacaggaataaaatgattcataacacaaagcatagttttggctccttatgagtaaaagaagagtgaatagagaaaatattccgtttggttcatccctcaccggaatacgggattacagaaccgggaactggaacgatgttgcattctccggacttattgagaaaagcaaatatctcattgataccagaggatatcctgcatggaccctgtaacctgtatcttctgcactcccgaaccggaaatattctccggacgggtataatatcgggataaacgaaggtaaaccggcaagtcagacgctaatgcacctgcatattcatgtcatcccccggtatttcggggatatggcagatcaaaggggaggggtcagcggagtgattccggaaaaacagaaggattaataaaaaatgacatgagaaatcgaatatttcccatgaaaatcgggatcaagtaggttgacatgaactattaattcgcataatctccttaccttcctcttgaacaattatctcagctcccctggacaaaagctgaataatctttgtgaatccaactctctcaattttttctggaaaattgggaatcttaacagttttcactctaggaattccatcttcaaatatttcattattgatgagaagataccaaacaatccgtaaaatcttacgagcaacagcaacaattgcttttttgtaaccctttcggggtaagagaccgttgaaatagtcattcaatttccctggtcttctaatcgcagagtgtgcagcttcaataagagcccatcgaagataattggaaccatgtttcgtgatgatccagtgtaattggtatttgtagactggtaaacagatggggtaagtcctgcccatttggctaatttatctgcggttggaaaatcatggatatcacctatttctgccaacaaattagatccaattactattccaatctctggaactgacatcaaaattcgtaattcattctctttatccttgaggtaaaatttgattctttcctcgatccttttaatctcaacctggaggttgtcatatatttttaacatcgaatctatgaggaatatagctgaatcaggaatataataatccggttctccttcaatagtcggagtcagacggtagacgataccaggagtactgttgatgaaattttccccttcagactgatctttgaataacgcaatccggctcagtgttgaaaacgtgtctgattcagcaacaagtcccatgcaaacaaggtcctttggaatgaccagcgtgtgcataatctcctccggatatccggcattcatgagggcctctcgtgcattttgatctgcaaccttgtcagcggtgaagataatgataatcggttcggagaagacattggttttgtatgccggttcactctgtaacctggataaactgatagaatctccaagacttgtaaatatccggtgatacgtgctcagttcttctgaatatcgtaaggcaatatattcaatatagctgaaatattcacattccggcggtgtgatcccaacatagacgatggctttatcaggcctcatccggtaatcaagccacaatcatgcatcctgcggattgatcggtgcatcggagatggtgttatttaccgtctgaccaggtgcttttggaaccttaaattgcatataaggattggttggattgttcccgtaacaagaaggagtaatgcccgcttcaaacagaccgatggggtttgtagtggccaagaacccttcctgtacttcgaacccctgttcctcaaatgctgtaattgtggcattattatctatccccgcaacgtctcgaaaacctgatgtactcaagagtcatcaggagaaggagactgcaggcatcctgaaaaaatatttcatagatgaggtcattagtagtctcgtggtataagtgttgttatttgagaaaaaattacctcatcttcttctcaaacggcggagttctaaaaaaaacccctaataccacaaaaggaacataatagagaatctcgatgttttctagatctgcatagacccagagaataccgataaaagcaacaactggaggaatcagacatttcatgaagagaaaatgagcatcttcatcagtcagtaatggttcacgaagatgaggggaagaactagcataatgccagagatagagaagaataatgccgagaataaaataatttatctgaaagaaataatctgcaaaggtgtacttctcaaggcccagattactaaatgctgaagagaatgggatgaccacaattgccatcagagccagcatatgcacatgaagaaaatgataatcgtatgtcttcatccgatgaaacatctgaaagaagagcatccagaacatcgcaagaatgacaaaaactccaaaaaagtctaacattgatgatatcgtgtttgaaaaaaactgatctacagtaattgtagacgcttttgcatattgatctggagttacaatatccctggcgagcagggtcatagtaaatgcaaaaatcccattggtgatccgctccagatttactttagatatgggttctgtgatcgtcatcgttctcctgaaagaataatggcaaagggacatatatattgttatcagtcacggatggtatgattctcttatctcttgaaaaatttagcccgtaaggtatatgagatataaaaaaaatcctgatcggattaatcacaatatattaataccagatagatcaattatcaccttatgctcggaatggaaaatatggccaaacaatttctttcctctccagaaggccagaagatgattatggactttatctcatctcctgatggaataaacaccatcaagaagatggtaggaaccccggaagggaaaagggccttcgggtctcttattaaaacagttcttccagcgttgggggttggcaatgaggagatgggaatgatcactggaattattgataaattcttgtaatcacttatatttacacgctttttccaaaatctcttccggtggaggaccatcggatacaatttttccgtcacgaaggattatcacccggtcaaaatactccatatgccagtcctcatgggagaccatcacaatcgtctgggccatctccttgttaatctgtttaaagagatcaagcacgtttcttgaactctctgaatcaagatttgcacatggttcatctgcaaagaggatctccggtttattcaccatcgcccgtgcaatggccactcgttgctgctgtcctcctgagagctcattatgcttatgagtcagccgatctgatagaccaatccggtcaagaatctgtaatgtctgtgcctggtactcttcctttgaagttccccggatcattgatgtcagataaacgttctcttcgacggttaattcaggcacgagagcataatcctgaaacacataacccagtctcttcagcctgaaccgcgttctttgtcgttcgtctaaggtcctgacatcaataccgccaagaagtatcttcccttctgttggtctgtccaaaagaccgagcagatggagtaaggtggactttccagatccgcttgcacccatgataccgacaaattcacccttctgtatggtaagggatactccccggagtgcatgaaccgtcacttttcccatatcatacactctggtcaggttctctgcgataatcattgtcagctcctcattgcggtaagaatatcttcagatgcgacccgccaggcaggaatgtagccggctataaatgacgcaatatacaacataattgtattattgataagatctgatgtggcaaccacgggtgtcacctcaccatcagggaactgaaatgggtacaccgtcaatattgcaaccatggactccacgagtgtcgtcccgacaataatcccaagcgtagtcagaatcagaacctggaagacataattatgaataatgatactcttctcaactccaagcgcttttaagacacctatctgccttctgctgttcaatgtctttatcataataacgatgaaaagcaccacaatggcaataatcaacgatacaacaatggtaattgagttgagcatagcaaagttctgaaccgcacgtcccatcgcctcttcaagaatatcctgccaggtctggactttctccctgatcccaaacctgtatatctgtgttttcacatccggttcataggagtcagggtcggttttaattatgacatcggtcgcataatcaacttttctcccaaaaaccgattccaattcatcccaggtgatataggctccctggtctgcataatatgaaccagtctctatgatacccttgacatgatacaccttgcttaccccattggtatactcaacagtgaccgggtcacctgctttcagatatccaagagtgggtcccatgtcaagactttcatccttatgaccggaggtctgtataccgatgattatctcgtcattctctccatctgccagataatctccatccgccatcttccggtatacgtcggtcacgaggcgttcatcatccggttttatcgcaacaactgtcgatcccaggctgttccctttgtacctgagcgtcactccggtcccataatgggcggatgccctgagaactccgggaattctgtttatcttctccagtagtgaaaagacatcctcaatatagagttcatcctcatgaggagagatgagaatattcccggtctgataggtgatgatctggtcttcagcgaccttgataaacccaaggataatagagggcatgaagatcatattggtaaagaccatggcgatgatcagtaccgtcagatacaggctccccctgctccctctgagaattccccggagtgctaaaaaaaatgaaaccctgaggtcgagaagcatcagtcatcctcgtttttatgcctcatgtacaaaaatccccctgcacaggcaatgacaataagcaggatcaggataatcattccggatgaatcgccaccggatgcaatggtaaggatgagatccttatcgagggtatgggtgccccagtcatcagtataggtaatggttgtgtgataggtgtactctcccgcttcagttccttcaagaacaaatgtggcaggagcatcatttcctgatttaatacgtccgataaaagcctcttttgctccctggatagggagatcaatcgttgcactgactgatttcgcctcaccagttccggtattctgaaccctgatgatgagattaaatggttcaccagggtttactctggatggcgttgtctcaacagaggtgatactgatctcagattcccctctgacatcaagccctatagatccggtatcttcaataatagtaccatcaagcagagcataggtcattcggaccggtacctcgatgattcctgtcggagtgttcttgtcaatgagaagagagaggttcttttcttttgacatgcctgatgcaagtctatcaatcatgaatgaactgattcctgccgggattgccatgggcggactgccattcacaaaaacacggatattatctgcctgcgttgaaccttcatttgaaattctgatggtgccctcaacttttgttccaggtttcaccggtatcggaaatgtgttttcaagtgcaagagatggggttttcaaaactgataactgggtgttgacattgaccggaaccggatatttcagactttgaccatcacgtacccgaatccagacttccgggaaatacatcccgcttcgttgtggtgcacgaatcaggaatgtaacgggaaccggctggtcagggccgatatttccttcaaactttgagtctcctcccaatatgtcaaagtctttggatttcaggaccacactgtcaatatatggcgtgatactggatgttgtctgacttatatcctgtccatatgatactgaactggtagttgtacccgttgcaacgctctttagagtgaccgtcagagtaccctcttcccctggtagaagaactgccggagatactttgtaatcagcaacaataactgatatctgaggtgcggcagataccagggggagcatgcagacaagagcgagaagaataaacgttcctgttttcgcatatctgtgtacttttgttcttgtgtggtttttgctcgtcttcataataatctttgtatgatgtatactattcattcatctatctattccatagttactgcaccctattctgatatactctcatcacagggataatagtcattcactccaccgtccgtaaagtgatatctccaattccctgcgagatcgtgacatgaatgactggggcatcaggatctcttgtctcatgataatatccagtgtcatctccggtaaacccggtcaggaatatattcccgatcgccctgtcaagagctacatttacccgggatctttctggaaacaggatggtaatatcgccagccccattctcaatcctgatgggaagggaatcccccttccattcatgaatatccaaatagagtgaacctgctcccgattcaagagacagctctgaaatctgcgcattacctggttgtatgtaaatatcccctgtcccgacagagaggagaagacttattggagtctggttatggattttgacatcccatctctcctctccgccgatgatatcatggaatatgtcacgtggtcggtcaattgcaatattcatcgtcttattggtaaccgaatgagtgagacggggaagataatgctttgcctcaacatgaacatctcctgaaagaagatattccatcgattggtcggaaatgtgtatagatccggtatctacggccagattgactctcgctttctcaatgtccttagaggggaaattgaattcagaatacccttcacggagcgaatttggtgaatcggtttccaggatcaaaaggacaccgccgattccaaaactcagaatcatgatgatgaagagccacccgaaaacctgtcgcagatttggaagatggaatgctatcatatgctctcactcccgtggataatggcaatattccatttcagatatcttatcccgatacgatacaaaatccgggcaagccagaattctccaataacgatcaataatccaagacaagtaagcccaattccgagaaatatccctgcgggggctgagaagaaaatgactcccgaaacaattccgagcatctcaagcactgctcccccggtgagaatcggtcctgcacagcagagagaaaatccgactaccaataaaacggcaagaatggtgatgatacagatgaacggaattaatacgacgataagattgaagagacctagaccaattgttgccagaattgctcttccaatacctccgaccgatggggaatgttctgctcttttcacgaatgatagggcagtatattctttgccgatagttttgggatctcctaatgattctgcgatttcttcttcagttctgccatccaaagcacccatttcaaagtgttcggcataatcggcgaggatatcctgccgttcagtttctgaaattcctgaaagtgccaggcctaattttttcagatattcatccttctgcattggtcatttctccgatgagatcgcttaccgcagccgaaaattctctccattccctgattaattcatcacgggcaatgataccctgcgttgtaagtgagtagtattttcgtgcaggtccttcatctgattcctggagatatgtggtgacatatccttcggttaagagacgacgaaggagtgggtagatactcccttcagatatctcaaaccgctctgaaatttcatgaaccaattcatatccgtaccggtcacgaagtccgagtaatgccatgacacacatatccagaacacctttcttaaattgcgcgttcattccctcccccgatcaggtttcgaatgattaatgtcgatatttgttttttcatctctaaattgacaggttccttttgtttttatgtatcttgtattacaagatagtgaataatacttgtacacaatcctattaatggtttcctgtacaatacgatgagaataccattatttttatgagaatcgtgtaggatatccttatatgcgacctattctaaccttctcctgatagatcatggattaataaaatgccctcatggatgctgcacaatttacccatgacacagtatggggaaattggaagcgatggattcttttagttatctggacgatcatattcccacttcttggtggatacatcatggatatattccgtgggagtactgttcctccggaatgcaatgactgggtaagacggtttatcgacggaatcaagtacctggttgcaggactcatatactcaattcctgtgataatcgtccttcttattacgtttatccctgtaattaaggaattcatcagccagataacttctgaatcggctgaattaaattacgaagcttttctccccttcttgatgccggtcattggaggagtaatcgttgccatcatccttgggatcatcgttaccctgatatttaccattggaatcattagaatggcacgaatgaaccgtttttttgaggtcttcaatttccgtgagattttaaagacaatcggaaagatcggatggggaacatacatcatcgctcttatcatcatctatgtgatctccttcatcctggggatgctcatcaatctggtaatggaagctccatttattggcataatcatcgcattattcctctggccattactcaccatctttgaatcccggtactttacccggttgtatgatgaatcaggggagtaatcccctcattatttcttataacatgagcaggatatatccataagtgcatggagtctgccatgggtgagagttcagaaaaagtgagtagaacaaatgcaaatagctcattttttacccggccggtgtttctgtcacttacgattggggttccgttctgcttgttcaaaattctctttggaatccagtttattcgggcagcagagattcatagtcagccttattttatctatgccggatgggttctcatgatctgggctggggctgatcttctcatgaatcttaccagagccggatttgatataattggcagtgcgggaaagattgaattctgtactctggctcagataggaagatatctgaatgcttcaactcttttcctcgcaatagatactttgatcaccttttcaatcatttgccttgccttatggtccgggtggatagtctatctgaataagaatgaggctattttatggtatagtgcaaccacactgaatctgataagtctctcactcgtgagtttatggaccgagataaaacggaaactggaataattattggtactcttttatgcaccaggaattggtgattgataccatttctggtcatcccataattttctataaccatagagatattcacataaagccgccttatctggtgaatatatgagaatcccttgtgttaaaaccctaatttgaatgaataatggaagtagttcaaaaattcggatgtcatatttttctgatttgatatttctccaagccagtgattggagatcctggggctcaaactccttaccagatacgatacaaatgtcaatatcacttctcgcatcagcagagtctgtagcatatgaaccgtataaaaaaactccaggtatactttgaggaataaatgataaatctccaagtattgatgaaattaactgttgtctatccatacctggagcgtcttggttaatgagatcatatctgataaagattgacatattcctgtcagtgccagagtatcatcggtcccattatatcggtgaatgatacggtttcgaagaccattcatctctctgagtagttgtttttgttcgttcgaaaataaatcgacacgatcaatattcgtataatcatctctgggagggatgttattatccctcagatacatggcaatacaatccataaaagcttctgttatctcctgaaatgctttaaaaatagctaaaaccgttttgatatcctgtagtgtttgaaaatcggaaagatcttcctgccagataccgataagtctggatcgatcataaatccaatttagtttatcaaggtagcgatctttccgcacctgatccatactatcatgttagttttaacaggtaatgagagtatcagaaaaattgggttattctttatgaggatgatgaagaactttatcctcaatagtatggacatccttgataagttcatcaagaacagacagcacagccggcattatcgcaaccgctccaatcagtgagaataacacggcaataacggttgtcagaccaaaattacttatcatattaaagttcgagagcatgagtgcagaaaatccaaagaatgttgcaaatccggataccataatagcggacccaatctttcgaacactctcacgaattgcatcaatagtgcttgctgctgtctctcgttcttcaagatatcgttccataataagaatcgtgtattctgctgcaacccctatggtcatagaaccaagacaagcagtcatcggtgtataatcgatgtttaggatgagcatggctacagcattccacccgacaatacagacgatgggaacgataggagtaacggcatgaatcttccgataaataagtgcaaggaacgccactatcagaataaagcccagtaatgtcatctgctccttactttcagaaatatctgatatcaaagtcgtaaagagatcaaaacttccggtgattgaagcactaataccgggtggcggagtgagaagaaccagatcattcgtcatctgtgtcttgagttcatcctgctgaggcatctcaagacgctttgtagaaaattcaataattgtctctgttctgccatttaaaaactcgttcctgactccctctggtattttggatattacttcatcaatttcaaactgcgtttgcggcacggtcccattgttgtaaattttgatataatctacaatactggtggacccggtaatctccatatacaaactgagttcgttcttttggaaggtctctatccatgtaagtacatcaggagagaggacattattaccagtaacaaggatgggaaccggtgtagtcgaaccgatagttctgctgactttatcaagagagatcttcgccggcatatcagacggaacaaaggtccgttcgcttgtggagatgggaattgatggatcaacctgaagcccgataaacgcaaagagaatggcaaccataaggataggaagcggatttttcgcaatggtgactgcaatctttgaaagaaccaaatctgcttttgtcggcttctcctctccagatattcctttcggtttatatttgattaatatcgcgataagtggaatgcctatgagcgacgtcatataacagacggcaaccccgatgattgcgaccagaccaaatgaacggatcatgggcaccggagagatgaacattgcaataaaacccatcgtcgttgcaatcattgcaaaaagaactgccggaccggttctggtaatagtaattctgaccgcatcaattaatgatccttttcgtgcctcctcttccaaccgggcatggaattgtatcgcataatcaataccaagccctataaggaccgggaatgcggcaataactgcagtgttaagatgtacaccgcatagtcccatgataccaaaggtaaggattaatccgattgcaacaattaaaaccggaatgaaccggtgactgacgtaggcaaatagaagaccgagcactataaccatcaggaccatggcacccataatcagggttcccatggatttactcagttcctgccccatctcctgctggaataccggattaccggttaatgttaccgtaacacccggtggaggatgtgaactgttcagaaatgacctgacattattcatgacactcttctgtttctgatcggtcattcccacatcaagtttgaccatcatcatagtcagcagattggaaggaatgtaatggtttaaaacttccgaggaaatactctctttaatatttttaatttctcctgaagaccttggtatattcccgttatttgcctgttttacaaggtctgctatacttgaaaccgagttaatatactgtaaattcttcagtcccggagtaattttatccaggtatgcgataacatcagggtttaatggatcattactctcaataagaatgacgagagtatcctgactgaaagtatcctcataatgagagaatgcaatacctttcggggtattcttgtcaaggtatgtttcatttccggtttgcatcttaagcatcgacattcccacaatcgaggcaataaaaatgagacaaagtgctccaagaaccagtttaggccggttcactacgagggatgagatgctttcaaaaatggaacgcatggtggttctccacaaggttccttaaacagacgcagattttctgcgggaggtgtggtaccggtaagcggcaccaatgattataatcaaaatgacggcgatgatgattgggttggagagtaatgctgagaaaccctctggtttgccagcggttatctgtactttgatggtatctgatatctggctgttatcaagagcatcgcggtatctgatctctgagtcaagtccgtatgttttttcgattgcctcagcattggttgtcattttaaatctggctattgcagattcacccggttttatgtctcccaggtatgcaaggtcatcatcacttgagaaaggatcaaccgcactgatacgggcttcagagctgtacgccgttgcatcgccatcattacggtattccacctcaatcacctgtttgctgcctatcgtaacttttggcggatcatttaccatggtgaacttgatctttccgccgaccgggataccgatctgttcagcgggagtctcaaggttctctccatcagcattctgataggttaccagtacttcaagcgggtattcctgtggttctgcatcgcgggtgactgataccttgaattttgcatcgaactcgtctccaggtttaaagtcaccaatgtataccgtactatctacaggaactaccggagaatttccaaatctggataattttgcaatcgccttacgaccggtgtctgccccactgttccgcagggtaatggttacaaatccctcaccgcctgcattgatatcttcaggggtgacttttataacgtccaggtttattgcagattttacgataaaaggaacgttcagttcgatcttcttggtattatatcggttgacaacactgtcggttccaacctgctcagctgcagcaagataggtatattcaattctgaccgggaggctgtatgttcctgcctgaccatcatctttgacacgtatctggaacttcaccggtttagattcagaaccttcaatatcaccgaccatctgggtatctgacttgataaggataggtgccccgtcagggagaagggttactctgaccattttggcagtagatggaatatcatcccgatcaacgattcctgactgaaccatttttatataattcagaccgctgttttctatcagaatcgggagttctatcgtcgatcccggggtaaactcattaattccggagatggcagcagataaattcggctcacctgaaagatattttgttccggctgataccggagaaatacaaaatactgccagacataacccaataaggataatagatggcaccctgaaagaatccaggttttttttcgagatacattctgaaaacactggttttatcatgtatggtacacctgagttggtttcacttgtgtataagttcgtggtatagatgagtatataattgttttgtttatatgtaacaaatgaatgtatcatatgtgtgttagtaatatgggtaacttatttgtgtaacgaatgcaaatcactaggtatgcatcggttggctgatgaactggcccacatcaaggatctactccgtaatcatccgcaagggatgagtgtaactgagatagcatctgctcttgggcggaacaagcactcaaccgggcgttacctggatatcctccatgctgcaggacatgtagacctgaggacttttggaatggcgaaagtgttcaccctttcatcacgagtccccctctcagcccttctctcctacacgactgatcttgtccttgttctggactgtgacatgagaattatccagggaaatgatcctttttttgacttacttgaaatccaaggaagttctgctcttcagaaaaaaattgaccagatactccccccgaatccggaaaataaaaaattcttaaaaattctgtcagatttactcatatcaaggcaggagacttttgaaattgttcgagagggccatgaacgaagattttttcgggggaaaattatcccaaccgtctttgaggatggcagctctgctgataccataattcttgaagatgtgacattggaaaaggaagcacttacaacccttcaggaaagtgaggagttcttccgcagtgtttcagatcacctctctgatggtcttattgtatctgagataaaatccggaaagaagaaagtaatctttcataatcagcgcctgtgtgagattacgggatattcagcagatgaaatccataagatgcgaccagaaaatctggcgataccagaagagaaggaacgatttgaaaaggctctcagggatgccgagcacaataaaggatccatgagagaactgcggttctgggcaaaaagaaaagacggagagtcgatctatctctcaattcgtgtcaaacttgttccctttggtgatgcaatccgtggatatattcttatcactgatatgacacagtggaaagaacaagaagaggcccaattactccaggcaaatctgatacagcgtcttatgacgaattttccgcatcccatttttatcatccgggaggatggagtattttttattgcaaatgcagcattttgtgagctgataaaggcagaatctgattcagtaatcggaaaaaatgtatatcaggtaatgcccgatgagattgctcaggaatttttgaaaggaaatgatgatctggtaaaacaaagtgctgtttctcatatacatatggtaacccggtttttcagacctgatggaacaatcggagatgtaattattgaaaagtctccggtatccgcaggtgataacactccgaattacatcttcggtgttgtaattactgaagatatgtgccctcttaaaaattagttacaccagatatctctacaaaattccattcatgtaaatacattttcccaattacttctgcgctcttaaggtttttctaaataattctctcaataaatatcgataaggatagtttcccttccacaatttaataaattttatatatggtggaaattactttctttctatcacgtgatcctaagaataccgggatctgttgtgtatggtgaatattgtatgcaggcagttgataccgcatttgtattgctttgtacagcacttgtcattttgatgacatttggagttggatttttttatgcaggtctcgtccatcggaaaaacattatctcaatgattactctttcttttatatcatttgcattaatctcattacaatggatatttttcggatataccctgtcatttggaaccgatatcatggggataatcggttcaacagaaaaaattgccctgatgaatgtctcgttagatggggataagcttccggagatggtattcatggtattccagatggcatttgcaggtattactttagccatagtaacgtccgcagtagcagaacgtattaaattatcctcatttctcctatttggattagcatggtctacgataatttatgatcctatcgcccactgggtctggggaggcggctgggcacaacagatgggagttcttgattttgcagggggtattgttgttcatatttgtgccggcttttctgcccttgctctggcatttgtcatcggaaaacgaagagggtttggagaatatactctttcaccatataatattccattaacgcttcttggaggcggattactctggtttggatggtttgggtttaacgcaggatcagctcttgctgtgaacacgattgcagtcaatgcatttattgtcaccaatatctctgcagctgcaggaactttttcctatatgctcacatcctggtattatggaaaaccaagttctctctctatgatatccggaacaatcgccggtcttggtgcaattacccctgctgcggggtttgtagggcccatggaagcttttatcatagggactgtttcaggaattatctgttattatgctctggttttcagacttgcccgtcaatgggatgaaagtcttgatgcctgggctattcatggatcaggagggctttggggaactttggcagcaggcatttttgcaacggctgcaataggcggggttaatggacttattgcaggtaacccacagcaactcatcactcaagcaggagctgcatttgtcattcttgcctattcattcataggaacatggatccttgcattagctatagataaaattataggcctgcgggttaaagaagaggaagaatatgttggtctggatatttcccagcatggggagagctccagagcctgaattattttaatatcactaaaatttttaacaaataatcatcaggactgtaatagcaccgtatctatggtaatggtctcacctggtccgggaaatatccattctatatgatcagtgtagccggaatgggatattacaagtttatatcggtttagaggaatgtcattcagctccagatatccctgagcaggcacttcaccaaaccagataccattcagaagaacatctgatcctgacggaattgaccgtatctttacagttgatgacacaggcatgagagttattgggatcatattcagatgaacatttgatgaaagatcatgccgggtaaataccatctcttttttctcctgatatccggcaatacgtccaagtacagtatgctgaccatcattcagtggtccaatcataagaggaatatttcctgaggtagttcctctgaagatgccatctacaagaacttctgtatccgacggagtagaagtaacgacaagttctttccgctcataatttggaataaggataaccttcatcgtagtgtttgagcctgaccggactgataattgttcatttagatatgatttatagccggttttatacacaagaagggtatgggttccttcagaaacggatgtgaaagaataggggagaggaacagatgaacccccatctaattgagcaagacaatcatcaggatcagaactgacaaaaatggaggtaaatttaggagcaggagagaggtgagcaaatacttccttctgagttccgggagtaatattctcattaattgaaaggatgctgctattatatccatcttttcgaaattctattatatatgggtgatctgctgtattatccgggatgtaaaggagaggggttttcccataatatttctcaagaatgtatacatcagcccctgatggttctgaattaatcatataggaaccaaataatcctgatgaataatttgtatctgcatacacattggaaattgccatacaggtaaaaatcaagactaacccccatcttatcaatgaaaaaattttcatgcagattcactgaaatgaaatggtatgtgaatatattaaattattcggaatcaatgattaattaatcaatgaataaaaatttaatgggttatccagaatccatgtttattacaaaagattctaactttcttcaccgaatcaaatggaacacaaaattcttttagaggagcatcacccggttttaacgttgatgtctgtagatacgtatccccaattacttctatccacttgatataatgatcatctaccattggatgaggtaccgatccaacttttaccttaattcctgaattagttttttcaataactggaatatgtttctctgtcccttcttcttcacccattttctctggaatgtgtatcatcggctgattacagcaaaccagggttccttttccttcattaacaataagcaccatctgcccgcagatgttacaatgatacaactctagcatgatatatctgattgtgaatagtatgttttaacttttatacttttcataaaagaggcagggtatctgaaacagaatttaaaaaatattcctcatatgaatttagatagacttaaatatatcctttaaatcgttagttttgatataaaaaatgaagataaaattaggagaagaattcaatgaagatgacgagcccgtattgaagaaaggatctttttcacgggtctcatcaatccccccagcttatctgccttttatgaatatataaaaatatgccatgcaatagggcatataaaattacataaatattaataaaagcctgaatttaaatcctatttttattataaataaattattgggttttgacatcgaaatcatcatgtactaatcatgaaccagtgatccagccatctgatttgtaatatctggatcaaggctcttcgctttatgaaccatttgataagcctgttgtttttttcctagttcatttagaattttagctttgtagatcatagcttttacatgtcgtggatcaatccggagtacctgatcaaaacacacgattgcttcggctagtctgacaagatttgtataaatctgtcctaaataaaaccaggcatctgaattttcagggtgtatatggataacctgcttaaataaggtaatggctttatgcgtttcatgcaatgcctgatgcgcccgtcctttatttaaaagtgcacgggaatctgcaggattcttattcaacactttctgataactttcaatagcttcaagaaaacgacctgcacgatgtaacaacacccccctgttaaaccaggctttcagattatctggttcttcttcagtgaggtattcataatattggagaagatctccatacctcttcaattttctaagagcgatgatacgatatgcctgagatgctgagtcatgcggatttatctgaagcgctcgttcaagtggtttgagtgcatcctgaaatttgtttaaacccatatatgcaagccccataagattccatcctgtcgaatgaagcggataataggtcgtgataaggcgggaagtattcagtgcttcttcatatcggttcattttcaaaagtgaaaaacaggatatccagagtcctgcatatgcctttggttttagccacagcaacctcttcgttgaagataacgcctcagaatatctctccagtttaatgagtatacgggattttaactcccaggcatgcacaaatcgatcatcgagttcgagcagatgatcaacattctttaatgcttcctctgggaaatttgacaggagctgactatatgcaataagaaaaagagttcttttgtggtccggatcgcttataagaagttcatggaattcctgtattgccgactgatattgacgaagtttaaaatgacaaaggcctttaaggaataatttcttttcatttttaatatcacctgctggtatctgctcaagatatgtgagggctttttgaaaatcagattgacgatattccccaaatgcaagataatataatgaaatggatcgagttctttcaaaactgaatgctttctgcagatactcccgggcttgctcaaaattacttaaatgtaaatgaatcatgccaagatataaccatccaagtggtgcctcctcatcagaatcaatgacttttgaaaggtaaggaagagctttaatccattcatgatccctgataagctgaatccctattgcgagatagggatgagaggctgattcagaattttcttgtagatctggttcttctttaaattgtatttcatcggattcttcctgaatcagggcttgatcatcaggtatttcaggttcttcagtcacctcctgaataattacttcagaaccaaacaggttgagcgaatcagatgtaatacgatctattgtattatctgatggcatatcctgatccataggttatccttggatagtaagggtataagtattatccgttgaacatagagaataattggatataatggtattaaaatcagaaatctcgagaatttctgacacaaataactattggtataagatataggattattattggaataatcccgaaagaaatttcatttccatcaataagaataccgatcaatgcagtaaggggaaagatgcctatccgaaatgataaattttttatatatccttgagacgtgcctttaaaaagaatcccgggtgagttgaatatatgaacccacaaacacaaaagagtcaacccggagattaaaatatttgcatggaaaagaatcccataaggaataggagcatcagaaatgctccagagcagggatgataagggaataaaaataattgtcagaagaaaaccaaaaatcaaatatacacagatgcggtctaccgaaacacaatgacgcatgatttcaaaagccagtatgtaaaatattgcgagcagaataaaagtgaaaataaaactaaacccgtcgaaaaatatcgagaaaaaaaattcaataaaaaaataaatgtcttctgatacatttcccgaaggtaatggaatattattttttacaatgagtgtcatcgcaaatgcaaatatcccattcataagaatttccagcatatcctgaggaaccggacctttacatgatagtaccggctttttcatctcttcctcctcctctcattacaaggatacctggttgtcaggaaccagtccagaaagaagattatcatggttccataatacaaatttctggtaagagcaatatcatatagcgacaggagaataccgatgacagcagttaacggtatatatgatatttttctagagaaacacccgtaattctgggtattttcaacagcagaaattatatttggagtatgtgtacaatgataccattcacccatcagaaatatactgataaaaaaaatattcgtatgtaaaaagaaggcaattattgagttttcttcaaatatctgatataaatggcttgttatcgggatgaaaatgattaagattagtaagccgaaatgtatggagatatatcttcgatcaaccttttttatttgatgaaaaatatgaaaagtcattatccaaatgagtgcaataatgagaaaggcatttacgaaactcaaaatatcagggatttgcatcagtccaaacgtatcaatttttgtttcatgcatcgtatcagcaaaagagggaagccggacatttttaaataataatagtaaagtaaatacgaatattccgttggtcaatcggccaatatttgtctttgtgaccggcccctcatcaaaggtttctattgccatataccttatggatcatatgatgtgtgagattatatagtggattttccgcttcgggtatggtatggagttaaatagatctcccaattcacataaaaaggccccggattctaaaacaataattttctctgtttaattttatattcctctaataatatgtatcgaaatgtcagacaagaaattatctcatctaaataaaaggtaattcgccagatatgcagtatacttcagacaatataaagagactattatatgaaaaacatctcctgatttataatctttctctatatattctgaaatataaatcagcataaaagagcagacaaataaatttggagatcatatggaatatttccaaatacttctaatatgagaaaaattttagcattaaaagcgggataaatctcaattttatactcaatataagagttcatcaaaataagggtggtataatttcattcagtaaaggaaattttaataatactttacattcatcttatgattattctataatttctatatttattcaattatctttagtagacccttacggttgaacccataatttatcgaaatttgcaatatcgagaggttgttgcataactttaaaccgctggtacaatgaggaaaaaaccagattttttatcgccgattttaggttccactcgaatggaaattatcctcttgcggaaatgacattttagttatgcaacagcctttctaacgaatactaaaaaagcattaaaaattttaaaaattcttctgatagtaaaataagatctattcttatattatttatgcaatataataaaggactactatgaccgactcgagtcttccaataaaaatatctaaagaattagaagaggtcgctgacctgttcagagatattggaatgaaaaaaaattgtgctctggtcctggtcgcgttacttcaggatgtcgatctttcttcgcgggagattgaacggattacaggtctcagacaaccagaagtaagtctggcaataaccgaactcatgaagcggagatggatcgatgtggtttgtcttataacggaaaaaaaaggcaggcctgttaaaatctatcacatcattaaaaagccagaagatatcctcgaagaattgagggaagaagttgttgatgattatgaaagaagaatacaggaaattgaacatataaaagagataattttaaaaaacaattgatctattccctgtatactatcttatcttcaactgatattgatctgaattattttcataaagttcctcattattctactattcagaatatgactcatatgctgaacattcagatatgtatagaggaatcagatttcaaggaaatacaagaattataaaataatgcggtaaccggggatcgaacccgggctaagggcttgggaagcccctgtcctgccgctagactattaccgcaggtgcaccaaatatattatcgattatccttgataaatgttacaatttgttccggaatctacttctctttccttagcttttgaatttcatgaagaaattctcgctgatttgcgagttgaatgtcagcctgaatgccaaacatgacaatttgaatgcctacaataataagggttactgaaagtattgtcagcggaatatgatcaatctttaaaagccactcataaacgatatatatcccaattcctccacccgccaaaaggaagatgagaccgatgagaccaaaataaaacatcgggttattcagcttggccaaccggtagatggttcgtcctatttttatcccgtcatggataggatccaatttggtatcacttccaattcgaacaccatacgatacaggtactattgcaaccttgtcatcatttcgaacagattcagaagatatctcagtttcaataccaaatccctcctcatataatcgcattctttgaagagatgcaagggtaaatgctctgtatcctgtcaggatatcatacaggtaccgcccatgactgatcttaaataaccagtttaatatacggttccctgttaaattcaggcgattaaatgagacatggttagatgggatcagacgatttcctaatgtctgatcatatccggataaaagtggaagaaccaaggcatctgcatctgcaggatcatatgtattatcaccgtcaataaggattacatagggttttgatatctgttctatagcctgaataaatgcagctcctttacctttacctttttgtatgattactttggccccggcttgataagccttgtctctggtattatcagtgctatttccatcgataacgagaatatcataatacccggcattatgaaacttctgaataagagggccgattgtcggctcttcattcagggtaggaataaggacgcagacctgttccttaggaatttccatcatatataggttattttagaaactatatagtccaatcctctcattctgtccatataacgaaagaagacatatttttgagagaaaaattataaataagaaacctgaaaattcaaaattctgaaaaattaaaaaaaattagaaattattgatatatcgctcaatttcccagggatggacagtaaggcggaattcgtcattttctgcaatagcaatcttggtcagattttcgacgatatgtgggccgagagcatcacagataactttatcttttaagagctcatcattcgcctcaataagggaacctgggagcatctcgatacctctgctttttctctcttcttcactcagatgataaatattgacatcagttggtgcaggaggaagaatcttgttcttaatgccatcaagtcctgctgcaatcataccggcaaagagcaggtagggattacaggttggatcagggcttctaaattctgcacgagtactgttaccacgagcagcagggacacgaatcattgcagatcggtttgctgcactccaggtaatatatactggggcttcatatccgggtaccagacgtttatatgagttaatggtcggattgccaagtcgggtaagagcctttgcatgcttcataagacccccgatatagtagagcatggtttctgatagctggttttctgcatttggatcatagaatgcgttctttccatctttgctgagtgaaccatgagtatgcataccggtaccgtttatccggccgattggttttgccataaaggttgcatgcataccattcataagtgcaagagttttcgctgcaaatttgaaggtaataactttatcagcaaccgagagagcatctccatatttgaaatcaatctcatgctgtgagtctgcaacttcatgatgagatgcttcgatttcaaaacccatatcagtcaatgcaagaacaatctcacgtctgagatcttctgcagcatcactaggagccaggtcaaaatatcccccatggtctacaaattctgtagtggcctgtcctttttcatctctcttaaagacaaagaattctaattcaggaccacagttgaaagtaaaccctaattttgctgcttcatctagatttcttttcagaacagatcttggatcaccttcaaatggtttgttaccatatgtgtaaacatcacagataaaccgtgcaacccgcttatctgccggtctccagggaagaatctggtaggtactgatatccggttttagaatcatatctgattcatcaatccgtgcaaatccttcgattgaagaaccatcaatccagataccttcagtaagggccttctcaacctgaacgacaggtattgcaacattcttggggatgccaaggatatcattgaactgcaggcggatgaatttaacattatcagcctttatccgtgcgatcatttcgctgacctttgcatcagacattgaaacatacttctacctaattacatttaaatttaacttatctctctcatttttttcttcatgcttattcatgtaggtttacatgaatgatcaccaatcaatttagagtgggggactattcaaaaaaaaaaggtaaggatttcagagaaatgagataaaatttcagcgttttaagttgataccggaagcgaacaggttaataaagatgaaaagcttataagaatcatacaagcagttagcttccatgccggaaatatccggaatttgctcgttgccttataatgcctgtcaatgagacttatgtgatcttatgtgtggaataatcggagtaatagataaacagcgtgagctcatggatggctcctccatcagagatgccctctcgataatggatgagcgcggaagtggggaaggtgccggatatgcagcatatggagtatacccggactacgccgatctttatgctattcatgttttttatgataatctggtagaacccaagacccaggtagaggatctcctcgaaacatgggggatgatagagcatgatgaagagataccaacctgggaacaggctggaataccaaaaatccatacgccctggaggtactttttccgccccaaaacacggttaatgcagcggagcagaactcctgatgatgaaattgtaaaacacattgtcatggaagtgaataaatccataaagggagcactgatattctcatcaggaaaaaatattggagtattcaaagcatccggatggcctgaggaggttgctgatttttaccgggtcgagaaatatgaaggatatctctggcttgcccataatcgttacccgacaaatacacccggatggtggggtggagcacatccatttaacctcctgaactggagtgttgtccacaatggtgaaattacgtcatatggaaccaacaggagatatatcgagagttttggatatgactgcacgatgtataccgacacggaagttgttgcatatctcatggatctcctcgtccgacgacacggactgacccaggaactggcagtacgagctcttgctcctcccttctgggatgaaattgaacgaatgccagaagacattcagagattaaatactgctcttcgtctcacatatggttcggcgatgatgaacggaccttttgctattgctgttgcttctccagactcgattgtcggattttcagacagaattaaactcaggcctcttgtaatcggtgaacatgacaacaaggtatttatctccagtgaagaagcagcaatcagaacggtagattctgcgattaagaatatctacatgcccaaagcaggccatccaattgttgggaggacggtggcatgatcattggatcccgaccaactaaattccaggttgttgttgacaagaaccagtgcatgctctgtggaagatgtgtagataactgttcatatggcgtatttcggatggaaccagaagaaatcatcacgaataccagaaattgtgtagcctgtcaccggtgtatatcacaatgtccccgggatgctattactatcaaggaacgtccctgtgattaccggtcacatccggtctggactgcccaggtgaaagaaaacatctttaaacaggcagaaagcggaaaaattctccttggaggtatggggaatgcagcacaatacccaatcttattcgatcacctggttctcgatgcctgtcaggtaacaaatccttcaatcgatccacttcgtgagccgatggaacttcggacgtacatcggaaaaaaacccagacaactcgagttcatccaaaaatctgacaccgacatcagtcttgtaacagagcttgtaccgaatctcaaacttgagactccgataatgatcggtcatatgagttatggagctatctctttgaatgctcacaaagccatggcaaaagccgtatctgatattgggacatttatgggaaccggagagggaggtctccatgaagctttgtatccgtatcaggatcatatgattgtgcaggttgcatcaggaagatttggcgttgatgtcaattaccttgaacggggagcagccatagaaattaagataggtcagggagcaaaacccggaatcggaggacatctgccaggtgagaaagtatgtgctgatgtctcatgtacacggatgataccggaaggcagtgatgccataagtccggcacctcatcatgatatttactccattgaagatcttaaacagctggtaatcagtctgaaggaagcaactgaatggaaaaaaccagtctttgtcaaaattgcagcggttcataatgtagcagcgattgcagcagggattgccaggtcaggagcagatgcagttgtaatcgatggcttcagaggaggaacaggagcagcaccatctgtcttcagggatcatgtcggtatcccgatagaagctgctgtcgcagctgttgatacaaaactacgaagacagggaatcagaaacgaagtctccatcattgcatcaggcggaatcaggcagagtgcagatgttgcaaaagccatctgtcttggagcagatgcagtctatatcgggactgcagctcttgtagcgatgggatgcagggtgtgtggaacctgttatcgtggtctatgtacatggggaatagcaacgcagcgtccggatcttgtcgcaagattggatcctgaagaagcgtcacataatgtaaaaaacctcattgaggcatggacactggaacttgctgaactgatgggtgctgcaggaatcaatagtattgaatctcttcgtgggaaccgtgaccgtctcagagggtatatgcttgatcagtcaatgcttgatgttctggatgtcaaaccgataggagcctgaaatgacaactattactatagatgctgcaggaattcactatactccgctcaataaacagatcaggcaggctgtccgcgacggagtctctgaaataattttaaaaaatgtcatgggacagcgttttatcggagatgggcttatcggcaatgtaaaaattaccattcatggagtacccggaggcgatcttgggatgttcatgaaagggcccactattgaggtattcgggaatgcagatcacgcacctggaaataccatggatgaaggtacaattatcattcacggtgccagtggtgatgcaaccgctcatagcatgaggggagggaaagtcttcatccgggatgatatcggctaccgtggcggaattcacatgaaacaatatcaggataaacgtccggtcctgattattggagggactgccaaggcattcttaggagaatatatggctggcggacttgttatcatgttccggatgcaggatgaagaaccatatgcagagatggggctcgcaagcggtattcatggtggtgaaattttcataagagggtcagttgaagaatggacattgggtatcggaagtagtgcgagaccggcaacatcagaggatattgatagaataaaatcattcatctttgaattctctcaatattatggcaatgaccctgcgaaattgatgaacagctcctatacccggatagcacccgtgagtgcccggccatttgccggtaaatatacctgggagtgaggacatgacaaagaaaaaaacctacactgcattacaggaagaagtctgggatgcgggtatatgcagcggatgtggggcatgtgttgcggtatgtcctgctgatgctctctatgttcctgatgatcctggtattgtccgccctatctcatccggatattgtaaacaggagactgatcaggtaccatgtggagcgtgctatgaagtatgcccccggacaaagccagaaaatggagaactgctcggtaattatctctcctgtataggtgcgcgtgcaactactgaaatttcaaataaacaaagtggaggagcagtcactgcgatacttgcagacgcattctcgaaaggtctcatcgatggggttattactgttacagaggatcgctggactcataaaccgatatcagttctggttaccagtgccggggagatgcttgaacatgcagggagccgatataactggagtgttccagtattaaaggcattaaaaacagcggtcgtcaccaaaaagttaacccggattgccatcatcggcaccccctgtgtcatgcaggctgcccgtctcatgaaagactcttctcatgacttggtaaggcccttcggaaaagcaatcagactgatggtcggtctgttctgcacggagagtttcaattattatcccttaatggaagagatactaaaaaagaaccacaatatacaacagtatgaaattgttcgaatggacataaaggggaagctcgagctgaccctgtcagatggaaatactgaaaacattccactgaaagagatagaatctgcaataagggaaggatgtaaatcctgtaaggattttactgctctagatgctgatatttccgcaggcagtgttggaacaccggagggatggacaacacttctcatccgaaccggagttggcgatcagtttgtaaaaagtgcggtgcattcaggaatgcttgaagttatgcaggaaactgatatcactgctgttacaagacttgctgaaaagaaaatttctcattaatttttaacctttctccggatactatttatctctctatagtgaatatagaaggagattatctgatttgcaatggatgataacacttctgaagaccttccccctcatagtagactatctgcaggatgtaaactctgttatgagggggcaaaattagttcttttcctcacaggattatgtcatcgtgactgctggtattgtccgctttcacaggaacgaaaaaaccgggatgtcatctatgcaaatgaacatcttatttcttctcctgaagaaatgatccgggtagcacaacggatgtcagctcttggaaccggcataaccggaggggaaccattctttttcccggaccgactgatagagtatgccaaagcactgaaaaaagagtttggtcctgaacatcatattcatctctataccgggatggctccggataaggatatcattcgttctattaccgggcttgttgatgaaatccggttccaccctcctggtgatctatgggccaatctgaaagaaacaccctttcatcagagcatccggtttgcaaaagatgccgggctggatgttggtattgaagttccctcgcttcccaatattgatgatctgaaagaatatcttcaatgcatagattttctcaacatcaatgaattggaatggggagatttcaacgctgatgagatgcgaagcagagggtatctcctcaggggagatatttccaatgcagttcagggtggatgggaaagtgcgaaaaatatggctgatcttccaaaagttcactggtgttcatcagattttaaggatcgggtccagctgaggatgcggcttagaagaattgcagccaatactgccagagaatttgatgagatcaccgatgacggtacaatcatttacggagtctgggaatgtgacgggaagcatgtatctatacccggtgatctggatgatgatctgttcgaacgatttgaagatcggatcgaaaccggctggtggatattggaagagatagcggataagataacaggttcagcttattttgttgaacggtatcctgatggcggcattattattgaggtgacaccggtatgattcgcagatgtatcgagcatatctatgaataccttatttcaagacagtgcatgcatatcccccggcatattgcaataattcaggatgggaatcgcaggtatgcaaaaaaacgaggaattgccacatcttcaggacatcgcgcaggggctgatcggaccgaagaggttctggaatgggcacaggaactgggaatacggcatataaccctgtatactttctctacagaaaattttactcgatccgatgaagaggttcagaatctgttcgcactgttcaaagagaaattaagtcgtatcagtatcgacgagcgcgtccataaatatggtatcagaatccagatgatcggggataaagatatgcttcctgatgacctccggggtgctgttgagcaggctgaagcggcgacagcacactatgataatttttatctgaacatggctctggcatacggtggacgaaatgagatgctccggacaactgccaaaatactggatgatgtcagaaaaaagaagataaaaagagaagacatcactccagaactctttgaagaaaatctctacggaaacagtgtatcactcccgccggtggatctaatcataaggacaggtaatgagtgcagaacttcaaactttcttccatggcttgcaaatggccatgagtccgcagtatatttctgtgctccctattggccgatgtttcgaaaacttgacatgctccgtgcaatcagggtgtattcagaacgacaggaaatgaaaaaaagatcggcgtgttaggatcaggctccaaatcttctgtttcgtgactggtaatccctaaacgcgcgaatcagatctatttttctaattttttcccagttcaggtccaaaaagaagagttccgaatagactgactgccagataagaaaatcaaccagatgcgcccctcctgttttaatgacacagtcaggggtgtgggaaaatgtcaggtatttttcaagaacgtcagttgtgacatcttcaggtgctacattattatcggccatagactgtattgcatcagatatctcctcccgaccggattttccaatagcgatagtaacggaaatgcctgttccgaatgtttcagatgtatcatcatagtggagatgaacggttgcgagatcagataattcgtagatatatgagagatattgtggttttgtatacggcctctgtgtgctgatatgtataataatttcagaaattccgatattttgtggatctttccttcggactttttctgatatctccagacaccaggaaataatgtgccttatgtgttttggatcattctccatttcagcatctgatatcataaagcagataacctgaggaatactatcaagattgcgaagaaggtgccattcataaaattggtagatcatagtatcctctcaaatttgcaggtcaaacgtatgcattgtcctctgaaatttagaattctcttattatactcggttatattatgagatttgcacatatcctttcagaataactggccctataacttctttatgataactataaaaggattcgatatgataatggtagaatgtgtacgaaaacccgggagatatcattgggttaatatgatagcaaaaccattttttaaacactgatgtacaagtatctgactggcatcgatataatagatcagaagggaggcgttaatccaggaacgaatatcctggttctggcaccatcattcagtgatggagagctggttgcatcatttctggctatgcccagaaagaaagagtacatgattgttcttgcaaccgaaacccagtctgaagacctcattgatttctttgcaggaaacggatttgatacgaattatatcggtataattgatgcaatcacccggacttcatttaccgccatagaggatacgcaaaagataaagtatgtgggaagtccgagcgatctgaccggtatggacattaaattttctcaattaactgaagagataatgaaaggggactttacagatgatcctgatcaattattcccaaccccaatccggtattgtattctctccctgacatctatgctcatgtttcgaaaaattgatattatctatcagttccttcatgtagtaacatcaaaacttcgaaagataggctctataggagtattcttactgaataatgagtcatttgatcaaaagacggtggctatcgtaaaacaacttatgaatatcgttgttgaaattcagaacaacgacgaggggaagaaaatccggatccagggaagcatgggcctttccatgaactggagtcatttctcaatagaaaatggaaatttactcattacgccataattatcatgctaatttttgtcggtcttggtctttatgacctggatgatatttcattaaaaggattacaggctataaaagaagcagatgctgttttccttgaaacatatacgtctgttctcactggtacaacgatagaacagatgcgcgagaagtatggcaaagatctcattattttaaaacgacaagatgttgagcagaaacccgaaccgattctgaccgcggctaagaacggaatagcagtatttctgaccggtggagatcctatggtctcaaccacccatgcagatctacgcatcagggcacatgaacagggtatcccaacaaagataattcatggctcttccatcgtaagtgcggtctccggccttaccgggctgcagaactaccggtttgggaagtcctgctctattccatatccagcccccaaatggtttccaaaaactccacttgatactattcttgcaaatctgaaacagaacctgcatactattgtgtatctggatatacaggagaaccgatatatgtcggttcatgaaggcattgaacttcttgaaaaactcatggagggatcaaccgattcaattcctttatttgttgggatagcaagagccggatcaaactctccggttgttgcagcaggatccagtgagagactaaaactggttgatttcggtccaccacttcacattctggtagtgccagcaagcttacatgagatagaagaagaatatctgaagaactttgccggatatgatcctcagtaattattatttcatactgatggaatcagctaataacatcactcttttaaattcaagaggatctccgtatcatgctctcggaatcgaaatctgcgagatgataacatcctatcttcaggattcggtatattttcaaaaaaatggcgatatcgtcaatcagtatgcatcattggtatatgcacatggatggctttcagcaggggtatttttgggattatataatatctcttttgggacacttgatttttcagacattgaattccctgatcactatgattcccttcatctctacgaaaaaacagagcggtatcattcaatgcttgaaactgcaatcaactccgtatcctgctttccgggaaaaggatctcctcttactctggcagcagataaatccctgaatgaagtcaaaaaatcgttaaaaagaggtgaagaattgatgaaagatggagagaccattcctgcacttggatatctctgctatggatatggctggctcgatacctctgtccgggccggtcttttacaggtccatcacaattttcatctcttcacaacagaattttaatgacgcctggattgtaattcatcccataccgactggagcgtaactcctgatctcttcagagcaagcataaaatgaaataaaagatccgcaccctcttctgaaatcctgtttttatcaccgttttttacagcaatgataaattcggtgcactcttctcctatcttttcaagagacttgtctattcccttactatgagtgagaatttttgaggtatatgactcttcagatgggtgagcagctctttcttcaattaccgcccagatctcatccataatttcagcttttttcaagctgcactctcctctggaaaaacctcaccaatttcatatccatgaaaccttcgaatgaggattcgtgctttttcaatggtacagccccctttcccaatcgcaataccaacatcatttttatctgaaacatagatattcatcttctttgtctgatcatcacaggcaaatcttatcacctgggctggtttgaaaatgtttgagagaaattcttgaagatcttcagcatattccaccatctcaacttttcttccggttactccctggagacgcctgatattatccccctttttcccgatggcatatcccatgtcaccggctttaataacataaatgattcgatcaaatttatcgtcgattaaacaatcaagtgctgttgattttgtgagaattctaagctcttcaatatatctacgttctttaaatccaagatttctttccataggtaattcagactccatattcgcaatctaatgatatccgatggtaatccagcagagaggtgagtataaagatgatacttatagccttcagataacactgggtatgaaaatttatgagccatctctttgatagaaaaccgtggaaatattaccggtttaattaattaaaggttatggtataaaagatgttgatatccagggctggtaaggggaacatcttggatatgaaagaagacgcataaaatcctcttgttaaccggtcagcaggtagcaagtatgctctgagtatctccaagaattgatggatatttgatagcactgctcatcggaagccgggcaaccggagcatatgaagaacgacggcataaaagcgatttcagggaatcaagagaaactgtataccggtttccatccatcagttcaatatttaaggccttccctgaatatgaaagatatgcaagtccggcggttgtactgacatattgcttccagtttaatcgtaactggaaagtccgtgcagagattttaccccggattgcatggtttaaatcttcaaggacaattccgaatcgtttgccgtcgatgaccagttctatgatctcagttggaagaccttcctcatcaatggtaacggcttttgctttctgcatatatcctgctttttcgagcatttttattatcacccagttgataatagagggtcagcagtaccctatttaaatctttaaaaagcagggtgaaagtgaaaattaatttataatgattatagaataaaatttaaattatctttcaaaagcatttttaaccaaaattaatagaggaaattttttcctttcactttcggaaatgagacttttttagtgattgattccctgatgatcgatcgttggaagataagatctggcaagtttttcaagttcttcaatctctagtggtttggggattacgaaatctgtattcgtcattatttcttcggcaagggattgatatgttgcagagagtgatgaatcaggtgcaaattcaataactgtctggttatttaattcagcatactgtaccaggccactcctcgggatataggcgattatcttcgaaccgacttcagatgcaaatgctcccaccagtttctcttcatctggaagatttctgctgttacagataactcctccaagtctgcagacctgtctgacattttgagatatccgggagattgccttacatatattatttgcagcatagagagacatgagttctccggaggtgacaagatatatttcctgtgcatatccttttcgcatgggcatagcaaacccgccacagacaacgtcgcccagaacatcatacacaattatgtcttcatcaaatgctgaaagtcgttcaagaagttgaaaagtcgcaataatgcctctgcctgcacatccgacaccaggttctggtcctcctgcctccacgcaccgaacccccttatatccggtgaatacaacatcatcaagggtaaggttctcttcaccacgttcacggataagatccaacaccgtcgggataagtatccctttcataagcatccgggtactatcacgtttcggatcacacccaatctgcataactgaaagaccacggtttaccagggctgcggaaagatttgctgatgtggtggatttaccgatacctcccttgccatagagagcgatctgtttcatccctattcagtaataatgcgtattatttgaggtatccggtttattgatccagatgattggataatgctattcttccattgattatctgccaggagagtatcagccgtacaaggtcggttccggtgatatgttcctgacctctgaaaatattaattggtgatatacctgtctggaattctatctgccgttctatcttatggatggtgtctggcatcagttctccatccacaacaagagcacgcatatttcgtgaatccggagtatgggagatacaggataatgagaaatcatgggatgattttttaaataagtcacacaggtcgatattcaattcaatatcttcaaagcagtattcttgtgccggcatcgagagcataacacggtatacattgcgtttctctccttcttcctttccatacgatgagtaagaaatctggatgactgcatcagccacctccctttgggggaacacatattgaaaataatctggttcacgctgaagaatttcacgaagaacttcatttttatcgtagtttcgtttcttcatatcccgccgtatcttccagtcatatttaacatctcgttccggatccacaaagatggtgtaatcataaagcgcgcgaagagatttcgttgcgtatggatgtagtccttcgattatgataaatttcgtcggagagaatagttcaggttcaccaaaggttccatgatcatgcaggtataccggtttttgtattgttctgcctgccttcaggtccatcagattttcttccaataatttcagattatttgctgtatggagcagaggggttatacccatctcacttcgtgtttttctgtcatagagatggtaatcatctaccgtgatagaagagacgagttcttcaccgaaaatatctgatattgctcgtgtaaaagttgatttacctgaaccggaatctcctgcgactccaataagatagaccaatggagaatgccgaattacttcccggaaattttcaggctgactcatgataaggttcaggatctcacgttggtttggacttaatttttcagttaattataatattgctggttcagaggcatgtttgcttgctatcatatcggcaagtttcatgagttcatccctggttttttcatcaggtgcaccctggatgtaaaccgggggaagaatttcagccttgatatgaggtatcatggactggattacgtcaattgtttttcctccccacccaaatgaaccgataatagttgcaaacctggtttttggttttaccagatttgcaagataggcggcattgaccattgccggatgcggaccgaacaggactgtaggggttgcaagaaccacagtggcagcatcaaccagttccattgcaagaagtccgctatctgcatcagtcagattgaatggttttactccgatattccgttccatgagcaggtcggtcagcatccgaaccatacgctcagtactgccatgcatcgatacaaagggaattaataccttatttttaacggtatcagaggtccattctttgtatctgtctaatatccactttggattattgtgtaaggggccgtgactgggtgcaatgattgcaagatccatctgggaaatgggttccagatacttactgatgctcgaacggaatggcatcataatttctgcgtaatatcgtttggccgatatttctgtccgacatggttcatccatataaagggaggatgtggcataatgggatccgaagagatcacaggagaagaggattttatcttccgggcagtaggtaatcatggtctccggccagtgaatccagggatattcgaagaactgaagagtcattcctccaaggtttagagaatcaccggtttttacaacctgcactctgcctgcaggaatagagagcaggtgcccgatgagatccttgcatttttctgtgcaatatacttttgctccaggaaacagttcaaggattattggaagacttccggcatggtcctgctctgcatggttgattatgatagcatcaatccggtcacaacctgcacagacaatattagtaataaactcttcttcatgtgaaggatcaacagtgtcaataagagcagttttctcagtacctctgataagataggaattatatgatgttccatcaggtaggggaatcaaactatcaaaaagtcttctgtcccaatcaatagtgccgatagagaaaatacgttcagtaatttttctgactaccatagagatctctcaataattttttaatatgtactcggaagagtagataaagcccgttatatgagagctgtgacagaaaatttttatctatgatgaataattttcttgtatgaaaaaagttattaaattgaaaggattcaggaatgacagatttatttccatattagtcatatttttatgtctggttctgtttggttggggagtaagtagtgcttttgaagtaaaagaagagtatgtggatttcatatcggagaatgtgacctatgtcagttccccacattatgttacgataccgcacacagaaccgccaccggtatatctgacaaatccattaaatgatgaatccggaattgttccgggtgcaattatatatggacgggttccaaaaagcggattaaataaccttattatcgataatataaacaataaccaggatattgttttcgctctcaaaaaaccacagtggccacatccggattttgcaattctgattcccgggggtacatcagtcagaataaaagatattccagatggtacctatgaagcgtatcttgcgaccggattgggatgggataattccaaaaaactatttctgaatgatcctgactattacctgattactgagccactctctctggatacatcaggagaggagacaagagcgggaaatcgtataacctacaaacgaacgtacaccgtgtattcgtataatattcaaagattactaaacgaaaattcttatctcaccccgttggacgcaggagaatttccaaaattcaccttgttttcataaaataatggattggaatatgcctggcataactcataactatccaaatctggctactcaccaaaatcccatcttcttttctttccactcagcacatttccaggtagattcaacttttggtctgatatgaatgatcttgtattttccatcactgtcactcccggcatataccgggattggggggtttctccagcattcaagccttaatatctctttattttttccaaagatcggaacacagaattgacaattctgacagaaatgcggatcagccataactgattagttctgatgtcggcaccatttataggtactctttattcctgacagtcaaatcgaaacctatatcgtacaccccgaatcacaggtttttatgaatcctggaatcttcgacaaatttttgagaccctctccgaaaccacacattgtcgaaagtcctcccccacctctgattatcagggggccgggtatggaatgccgggagtataacgagaaaccatactttattgtggcctctgttgagatgggaaataccacaacaaaatgcatcctgaccggtgtgaatcttgaaaccggaatgtgctatgtcatcaataaaactgtcagtatgagccgcgatgtcagaccgccccgtcctggtgaagagatatttggcaggaccctggacggcactgaactgacacgtgaatcagtaaccgagttggtgcgtgacacgcttatcaaatgtcataaggatgctaagctggacatcaaaaaagaccttgattttgtggtcagaagtactggtgtcgttgcggcgatggattctcctgatcaggtcggagattttatcattgcacttgcaaacgggtgccttgaggcaggggttcctcccaagaagatgaccccaccgatgtccaagatgaatcaggctcagaaattacaacccttttcattcgcagaccgggtaaatttttcaggtgcagtcgcaggagtcgtcccccctcagggaaccaccggagttgagatggtagcaaatgagatggagggtgagctggctatggcgggtatcaaggaaggtgcaaaatggacccctgtagactttagaaacccctgcatctctatcgactttggtacaacccttgacggtcggatcacctctccggtagatccgaagtcaacaaatccgtttgctaaaaccataggaaatttctgcggtctggccggagcaatccctgatgcaatcgtgaaagggaccggactagtgaatgaaaagaacggaactgcccttgacatatttggagagaagagccggctttctgcagcaattggatcccgtaaatcatcagatgtagtcaactcgtacgttgatcgctgtcatgacctgatatctgttgaactggttccaaaagaacgaaaacgatatggtatggtgccggtatatgcagaagttgccatggaatcaggtgttgcattgataggagttgatgcaggaaccaatgggacaaatcttgctaaactgggtgagataggaaaggagattatcacgaaatattcattaccggtcctgaatgaagttatcgaccatgtttgttcgaggatggccctgcgcatgattgatgtggtacatgaactgggtatgatatatcctgagacctccattggtttcactggcagggctgcaatatccggaaagaaaccggaatatattctccagggaattattgatagaaaactcttccagaacccggtagatcatgtggtatttgtcgatgatggccttgcacgaggcgcagctctgatgggcaggtgcatgaattcccttggaaagccggataaaccaataggtggaatgaggggtggtaaatgtatcatgtccaggcgtattgccattggaagataacatcttcctcgaattcaaaaggaaatgctcatccatgaataatcgtaaattataaaatatggaagaagagcaatattatgaccttgtttttcccccggggactccgcggactataattcgtgagataatcaatacatttgatgtagagctcgtggaacgggctgagtccctctcttttgcaaatatggaaggagatgtcaggaatcttatcgccgcacgtgggaaaaaagagatcatgattgaggttgaaaagttttttaaacgaaaattaaacgaatttatcgacgagacaccagcataaacagactcacggtcaggatgcccagggataatattatggtgcctccactcaacggacttttttgagttggaaccggtacggaatccggaatactctctgtgggggtctcttcaggtatcataggagttataaccgtggtaatctcggtctggtttatatctgactgcacctcattatctgccggggtcgtctccacctcacttttttccatgaggtcaaacattgcagtttcaacatagccttttccgatgatctctgctctgaccatatacgtatctggggcccatcctgatgaatcaaatgatccattccaatgataatccaaattctctctactctgaaccggtactactaccgatccgccccctgccatggaaggctcatacttccctttcggtccaaatgatgcaggccagatctcgatgagaactgaattatcagtattgaaatttgtcgtacctgctataccaatcaaatctccagtggtataggaagattcaacctggatatctgcactgaccgtgctgataaaaacagtgatcaaggtcagcagaattattcctgtgatacatagtactttcatactatactatgatgagtaaaaatcaataaatcaggtacattgattatgaatataccgtcatcatctcattgtaacgcaggtaaccaatcagcgttcgcgctagagcatgccccctatgaacagccctgttatatttcaaaatggcttcatcatcaatccataccggttaaagatgtcaatttatggaacggagatgatcttcctgaagtggaagaggtttcctttctgattatcatgggaggtccgatgaatatttatgaacatgagaaatatccctggcttatcaaggagaagagattcattcgatccgttattgacagcaatatccctgtgcttggtatctgtctgggtgcacaactcatttctgatgttctgggaggggcggttaccagattatcatacccggaatacggatggatttcagtttcacgaacaactcatgtaacagagaacctcccattctcatcaataatcccttctgatctgattgtctttcagtggcatcaggatacgttctcaatccctccccgagcaatccatcttttcaaatcatatatctgtccaaatcagggatttatctataacgatactactgtcggtctccagttccatcctgaacttgatgaatctgatatccgaatatttctggaactcgtggaaaaagataccgaaattactcatcaggattatccaaaagacgacatagttcagaatatatctcattataaaagaggaaatgaatttattgattcactattaacgttcctgttaaaccggaataaaacccaaataccccggtaaattcatctttttgtatagttacgatctattcaaatcttaagaaagacgaacaatggtatgcttgatcttctctttgagacagagtggtctccatatctggccggagcagggataggtgttctgctctggtgctcattcctcttctcgaacaaacccttagggtgcagtactgcatttagcagaacatccggaatgatagagagtattttctgcccagataaggtaaaaaacaaggagtactacaaaatgtttgctcctgagatagaatggcagtggatgatggtttttggaattattcttggtgcatgtttatcttcggttctttcaggtacattacagatctcttttattcctcaaacatttcaggctgcattcggagataatattctcctgcgttttcttatggctctggtgggaggtattatgatggggcttggtgcccggtggtcatggggatgcacaagcggccatgggatatcaggaatgtctcagttatcactcgcaagtctggttgcagtcatgggtttttttattgccggtatcgggacggctatgatactctattcatggtgagggctgattatgttcacaaaatgtcatgcaaatgagcgccttcagttaatactcggactcctcattggtattgggtttggtttttttctgcagaagggcggagtgaccaactatgataccatcatcggtcagttgcttttgacagattttaccgtggtaaaagtgatggtttctgccatgattgttggcatgataggaattcatgtaatgaaaagcctcaatctgatagagtttcacacatttaagggttcaattggctccagtgttattggcggattactattcggaataggatttggccttctcggatactgtcctggcactgtggccggtgcgataggacaagggcagatggatgccctactcggaggtgcagttggaattcttatcggaaccggtctgtttgcacatttctatccgggcataaatgataaaatcctatcaatcggtcagttcccggttgagaccattcctgaattaattcatctcccgcgttggatggtggtgctggtatttgtggcagggctgtctggtgtattgtggtatcttcagatactggggttgtaagtacttcctcaaccaataattttacagcatcatggttgtaacgccgccagaaaaacgtcagataagaccctgttctgtatgtgcattctttgtgttcaccaccgataccgggcttggaagatgtaatctggggaaggatgaaaagcagggatatgataaccgtcgatgggaacttgatgagttaccagatcttttacgatggccctgcatgtataatctgacacctgaagagattgaggtctcgatggattcctgggtaaaaagtctggtgcatgaatcactccgattcaggacatcagtgcagaccaggcgatcaatatcatccggccggagaagaggaaatcgtaaaatctaacacatattattaatatctattcaattcacgcacgatatctgataattatctggtttatcttgatatattgcaatagggaatctccaaaagaggaacaaaaaatattggatttttaggaaatatataatatgactaaatattaatcgtactcacgccaggtatggttacacttactatttgtacaccgaaagaaccggacctcactttcatcagcagaccgaagttgccggagccaccagaatgcttctccattcccacaattgggacattttacagcaatggtgggcagggtgcggaccgattcggtatcatcgacgataactatctctttctcctttcttttatcggtgatcttcatctttgtctcaccatgaccttctttttcccagccgcaggaggtacagatgaaagagcctgcctgattttttaataatttgccgcacttctcacaaaacatacacataaggtctgacaaagaaacatttaaaacatacagcagcctgacataccagaacgttagataataccagtgagagaaggattatctgattatcatccagacaatatgggaaatgtttgaacttcttattcccatttcctgtctgtttttcctgttcgctctggttccgggaagacaccggacctatgcagccatcattgcctggataacaatcattatcgtctttatcggcggtctcccgacgtggatagaggatagtaatatcctatatccggtgatggctctattatctattcctttcctcatcattactacacggcttcttctgaaggggaatgatgccgttataaggctgacacgggctgcaggggtagcatttattatttatgcgccattcgcatttatagaagagataggaaaatacctgatagcaaccgtagtccaccacacatatcttgtcctccagcttctggggtaccctgtatatcttgtgttgtggaacacctttcaaagtggatttttcagggttgaaataatcctcgcatgtacgggtattcaggctatcgcaatcatgcttggtgtcgcatcagcagtccctacaaccaccagacaaaagtgtcttgcattcctcctcattgctccggtcatctatgtcctgaatctgtttcggaatgctggagttatcatcacatataccagccagtctttttcatggttgccggacatttcggggaatacagaatatggatactccagttttttctgggcacacaatatttttgcagagggggttgccctgatattccttatacttcttgcatacagccttttcaagctcatccctgctcttggagattttgccggagatcttgtccaatcgtatgaaaaagagattaagagtatcgtcggtacagatacacaatcctctgaagtgcagagagattagtacagagagcaattatcagaacagatatccagataaaaccggtaagacctccaagaacgagcaccaggacagtttcaggtcttccaaaaaatccgattccttccaaaggatcatcaatctttccttcttttcgctcagtaaatccaatctcagcataggtaactggtttgatgaatgtgttcatcatcgacccgataatggcaactgccacaataccaaaatcccagactggagagatcttcagaaatccggagataatgggaattcctgaaagacctacccccagaaggacgatagtatccacatatttatctgctatccaatcaaaaactgccccaaaccgtgtctccctcccggtcattctggcaactgatccatcgacgagatcgagaatagccgaacagaacaggaaaagactgccgataaagtatgaatgtaaaatataggatactgagcagatacagccggtcagaattgataatatcgtgattatgttgggagaaagcccggcccttttacatatttctgctatcggctcgagatacctgataaacctgtaccgaaatgcagtaatattcattcttcgctcagtcgttgataatgatatgagatatttctgccgatgaacatgccacctttgcacagctcctgatgaactttcctctaagagatcgtggatatcagttcaaatctcacagcatatattagtcctgttccatcaaacattactgctacatatgtctgaccatataaaccgcccttatgttaccctggtatcagaagtgacaattgatggaaaactcacagttacgaggggcgcttcatcaaagctcctgatgcagtttatgtctcatgaggctgaagtactgctccatcagatccgggctgattctgatgcaatcatggtcggggcaaataccatccggatagataactcatttctgaccgtcagacatgtagaaggtaaaaatccaatccgggtcattccgtcttcaaaagcagatatatctccggatgcaaatgtcctctcacctgatgcaccaaccattatcgcagtatctgcacgggcagataaggaaacgtgtacgattctggcagaaaagggtgcttacatagagatctgtggagatgaattcgtggatcttcctattctgatgcgcttactctttgaaaaatattccgtgcaatccctgatgatagaaggagggtctaccctgaatggcaatatgttccaaaaaggcttaatcgacgaacttctgctcattcatcttcccttcattgctggaggagaggatacgccctcactggtcaccggccttcatccccgtgatgtatcagatcttctgaaactggatctcattactcacttcatggctggtgaaaaccttatcacaaaatggcgtgtggtcagatcctgaaagagcattcagatcaaaccatatccattggatctgctttcatgagttcacgaaggatagttgtagcatactgaccgggaggcagagagaacctgacaagaagatctccatcaataatctcatatgtcagatctgttttcatcagcatgggacgaaatgatccggcaaattttgtatcaagaacagatgataccttctcaaacatctgacttgaaatacccttctcttcgagaacagtgtggatatttctgtcatcaggtccggcatcagaaatatacgatcctccggggagaaccagtgcgagggcacatgtacctcttttaagctgaaccttcgctgcatggatggtcgccggtgtgattttatcagtccttccatcaggccagataagataatccccaacttccggttcgaataatgaatgaccatcccggatacgcatgctcaacgtagtattaaaaatccatgactgcaccgcactcacatacatagaacgaagggtcctggggagttgcaggatggcacccaggtaatctcccggataacgtaccagatgatgtagaactgaacgttccagtgataaccggggagggagaagatggagacaccgggcagcatcttcagtttctagataacaagctcttccttcctgttcatgatcctccatctgcgagcctggttttccaatcatcaccctgacggcttcctggtaattccctttcagtatctcaaatccgataaggtgtgtgaccggtcgtgagacaccaaaccgctgataacctacataatttggtataccttccttgatcgatttctgaaagctttccagggaagttaataacgatgaatcagatatcttcctgatacgaatagcaaaactgttaccttggagatctccaagttttatcggatgttgtgatgttccaagggcggtcaaggtaatatcgggaattgaaagccgtgctatctcttctgccttgatcttataaatcgagataaattgtgtggtaacagcccgtttatccttcgtccctgcaaatccaatccgctgatgactgatcccaagtccggatgctatcgcttttattgcacggtgttgatcccagttcctccggttcagtgaacagataagatacggcccgtcggaatacgtatggtctgcaatttcttgaacttcaaaatcatcaggcagatctcttagtactcccccggtgccgggcgattcagtcagatagtaatggagaccaagttccctatcaatatcccagggactttccatcatagtaatgagagggatccggtaattttatcaaggtcttcacatttcgccggtccaagaccaagagcggtaatagtgccgggtggtatctccgtcattcccgcatcctgaatgagaaccgctgcaattcctgctgattctgcgagggttttcagttcaaataatgtcttttgatctgctgctttcagaaccacctttttctggccctcattcatccatgcttttttaagtgtcagcgaacttttttcatatgcaccaattgccgcatgtcctgcctgagcacattttttcccacaactcatcttcacatcattacgaatgataatacattgcttatatttgaattcaggttctgtcgccatctgcctttagacgttggtgtgacgagtacaaaggtctgttctccggtgagttgattgccggttatgaagagtactataccagcacatgaaccggacatatgatgttgccattgtaggtggagggccggtgggatccacagccgcccgaatttgcgcaaaatcaggtcttaaaacgttacttatcgaagaacaggcacatttcggatatcctgtacaatgtgccggtctgctctctgatagtgcttttcgggaatgcgaagtctcctgctcatctgtcctcaataccgtctctggtgcggatgtgcacgcgggagaagcaacctgctcatttgatgccggtagaactatggcatatgtggttgaccggggagcactggatcatgagatgggaaaagcagcagctgatgccggtgctgatatccaattgaagacgatagcatcaggtatttcgcgcacatctggaattctacatctaaaaggagtcaatggaccagaggatgtttcgtattcgatgctcatcgccgcagatggcccccggagttcaattagccggatggttgggataccccgtgccccggtatatctttctggtctgcaatgtgatgtgcaccatgctcttccccccgaccatgtgcagatatatccaaatgcatctcctgaatttttcggatggatgatccccttgcatccggatcaaacacggataggtctttgtggaattcatcacgtgaaggaacgcttttctgaatttataaaaccctttcaaaacaaggccacccacttcgtaagcgggactatccctcttggtactttgacaagatcctatgatgatcggatacttattgcaggagatgcggcagcaatggcaaaacctacctcaggtggcggagtatataccggtatccgggcagcccgtcacgcggcagaggtggcgatccggtgtattgaaatggatgacttcagcccgaaggccatggcatcgtatgaacatgcctggaaagctgattttggtcatgagattttgaggggttttcacttctttcaaattcggcagaagatctctgaaaaagatatggaatctctgataagaaccttgtcacatccgaatttgcaggaagttatcaccagaaagggagatatggatcgtccatcaggccttatcaaagcacttctctcccatccccgtatgattcctgcatactatcttatggggaaagccttcgccagatcaaaactataaatatgtaaccttcatacctttgtttctcaataattaggggtatggcaaccaatacaccctccagcagattcggacgtggctttatcgtaaatattacacacctgaaggtgaaattttctcttccggcagaacaggcctggtatggtgcccaggattatctgactgaacttaaagttcctgcacaattcaaagggactgaagtcgaacaattgacagagatgctccgtcaaaaggttgtctggcatcaggccggtggaccggttgacaaagaaatgtatactgatgtcagaagaattctgaacaggcttattgtagcgatagacagagaacttgggatatcagatgcagatatcggacaataccatgcatgagttttttaaaatccaattaaacttcgtacagtactgataaccccacctatggtatctccatttttaaactgaacatttgcaagagcatcgtagagttcagatttttccccaccagtctccagtcccttctgcagggctgataatgcatcttctctctgaccataaaatgagaatataagtcctttatagagatatccgcgggtatacccgggttccagctcaagcgccttattaatatatttcattgcctccagataatctccgagtaatcccgtggtatacccatatgaagagagcacctccggatcatttggaagaagatccaaagcccgtttataggaatccctggcactttctatccgtttgatctttatcgcagagtcacctttcttcttccagccttctccataatcaggagtgatggccagaatctgatcatagagatctatcgtctcctggtatcgcttaatcttataattgattaccgttgttcgttcccatatcccggtaaaccggacattgcttgcaatagcaacataataagagtccattggctgcatatccttcgttatccgggtttttttagatccctgataataccagagatcattctttgcaagggcgttaaacccgccatcaaaggagtaaaaagcttctttccagttacggttatgatattgtgcctctcccgatacaaaccaggcaggcacacaggtaagatccatgtttctcgcagtctttgcaactcccaatgccccgttataatcacctttctgaagatatgaatatcctttatttgcatagaactccggttcatcaggttttaatgaaatagctttatcaaatgcagaattagccttatcatattccttcatgttaaaataggtgacacccatgttgttccatgccgccgcgtaaccagagttcagattggtggccttttgaaatgcctgaatcgcctcggtaaatttaccggtccgtgaaagtgccacaccctgaacattatactgaatcggatcatcaggatttaatgtaacaacattctgaaatgcttcaacggccttatcaggctgattcagatatccccaggaactaccgatgatatgccaggcaaaactacaggttggatctatcttcaggcattgttcagatgtattaattgcttcagggtatttttcttcattataatatatgagtgcacgatactgaagtgcggtcagattctgtggatttagtgagaggacataatcattctctttgatgagatcctctaaggtaatggtatcaacagtctgatttgtatcttctccgctggcaaaggctataaagagtatgataatcaaaactgggaggatttttctcatatacattcctcccgccacatatcctggggggttatgctatattggaagccaatcttaaaaaatgatatgatatggtatgaaaagattatcttttccccataaaggagttgatatctttgccaagacagccgattgcatcagatctgcatcgctgacagtgtgacatctgtctgacatatggtttacatttctcctgcattgccagtttttcctctatcgtcggaggggctatatgagcgaatttggcctgtgctatgagcgggatgatattatggataaatacgcccatttcactaatttttttggcaatatccggaatatggtgatcattaatgcccggaatgtaaaccgtatttaccttaataagcatctttttggcgacagccatctttattccctcaagttgccgtgaaaccagaatctctcccatctcatggctggaataatagcgccttcccttataatcgatatactggtatatttttgcggcgatatcagggtcaattgcattcatggttacggtgatgttggtgaccccgtatttttccagaagatcgatcttatctggaagaagaaggccgttcgtgcttacacacagaataaggtgtggatatgcttcatgaatcaaccgaaatgtttcaaaagtctcttcattatcgagagggtctcccggtcctgcaataccaataactttgataaagtgatactgattaataatttcgcggactttttcgagtgcctgctgagggtttaagacttcactagtaacacccgggcggctttcattgacacaatcaaatttgcgaacgcagtaattacattggatattgcattttggtgcaaccgggagatgggctctgccaaaggtatgacttgctttttcactatagcagggatgttcctggatcttacgaatctggtcaggatcccatttcactatctggccatctatttcagtctcccggtaggattcttcagccatggattacacattatccttttatctattaatatcggtcgatgattgtccggaagatttagaaggatgatcctggttcagctgacataaggaacccgctggcccggtgttcacacgatgggatctcatccatccggatagaatatgcattatcagatcctccctggatatctccatttcatgagctacttcatcaagagaagtacacaattcaggagaaagagtaaacagaactgattcatctctccggcttatagagttctcactcacttctcgaggaaatagcctgctttttacatggagtaatgataattcacagaccgggataaaaaagtaacagatagaactccatgatggttcaatacaagacataatgattgccagaatggatacaaatgggactataagacttttggttagaataaatctgtaatgattatccggaatagggattgcaagatgtgaagagttcacatacacccattgacaaaaaaatatcagaccgagcagtaacatattcgtatgaaataacagaactgccggaccttcggtatggttatctccggccagggttgatgtaaaagggatcagacaggcaacaaatagtaagataaacgtaagcctgatgaggaaaggatccagttttgttaccagagaaaatgtccggtgatgtgcaccccagaacgctgcaaggatgaaaaatgccaatgcaaaatggattatctgtggaatcatcgcaatgcatatctctgccggcgagagatcatccgcctgtccgggaagggccagtccgaggaccagaatggtcatgataatggcaaaaattgcatcaaaaaatgcttccagtcgatgaggggtcagttcagcaaagggaaacgggtttattagagcgggtgaattactggtcatggtcgatctgataatttgactcaacgaatatatatgataacagaaaaggactacttatggcacaggacgttctcgttgatatatccgattctgactgggaaccaatggttgaacgaaatgaaaaacctgtttttgtcatgttttacagtccctcctgtactcattgcatcaggatcatgccgtcaatagaggaacttgccagggattttggaactgaaatcgcgtttgtaaaattaaatcttatcaggtttgattacatcggggaacggtacggtgtcatggcaacaccgacttttatctatttctgtggaggaaaaccggttcagactcgtgtcggtgcagtatttcctgcaatgctcagaaaaatggttgaagatatggtaattcacggagaagaatgccggcttgcgtcatcagactggaaatataagattaccggatatgggtaatctattcagtctttttttcttcgcctgatatttctggggttgtcgttgtagaattgataacctcttcaacaatctctgcagttcgtgcaagatagaccagttcaagaataccattacgaaatgttcggatacaggatgactcgactaccggtggtaaaggagcagaactccggtaccttatcttcccatcaaatccaatgatgtgaagagtgttttctgcaatcgctacatttatatgttcgtcatataatcctctcaattcacaggtggcaataacccggccatcccattcgatgacctcgattggcggatgttcaatatcatggcctgggcctgatccgccgggaaaaggaaatcctggggggagatttcctgccatgatgatattaacgcctatcataccgggtcttagctgcccgctgccaaatgcctgggagagtatctttcgcaatatatcttccatatttttgaaatcttcaggtggggtatcattcatatgtaaaattctcactttaagattgggttttatttcatatcaagttcctcagcaagatttttgtggtggggaaattttttttgtctgactttgacatcctgcattattacagtagattttatttccatcattcctttctgaatccatgcaatattgtaggactaaaaatgaaaatttaaaaatttatcgggtatttagatccggaaagaaactcttatgcagggtatggatatctcatcgatatgaaaaatcacataagatctaaactccctctttcatgtatcatgatctgatatgagaacttcgcgcataaaaggagaacaaaaatagtaaggttttttaagggaccctttatctctgaagaatgcactatggttaaatcgactattctctctaaaaaggcactatgaataacagaaaaatcattagaatctgttattctggttccgcattcttcttgttgatacattcatgtaaaagattctcaactttgccagtaagttcctctatacgggtgaaatttttctcttcccagaatgtcaaatcccgcagctcattagcaatgtgaatcagatctgacgtaagttccgttacaagccctgcccgttcaatctgttttaaaatatatactgcacggtggagaacctgttgtttactccgcgggtacaagagagcccaggcacctgattcaaaaatttccagattcttattatcgagagtcccttgcatatgagttaatatttctttgaggtattcggtagttatcctgggtacatcttctggtctttttgtctttgtgaacacatcatctagaagattcatcttaacttccctcacaaaggcatgaatgtcagcccctacaaaataacgcatctccctggcgatggcatcataatcaatgttttcatccaaaagagtgcccaagtctcttaaataaattttcagaatcgcttttctgccgttcagattcgggggttttatatagatatgtttttcaagtcttcctggacgaagcaatgcaggatcaagcaaatcaggtcggtttgttgccgccatgataaccactccggagagttcttcaaccccgtccatctcggtaaggatctgtgataacacactttctccaacccgtgaatttgtatgttgctggccccgttgctggacaagtgcatctatctcatcaaaaaagatgatagatggagctgattgacgggcttttcgaaatgcctcccgtacctgtttttctgattcaccaacccattttgataacagttcagggccttttaccgaaataaagttcatacgcgatttggcagcgacggccttggcaaggagagtttttccagtccccggaggtccaaagagtagaattccttttggtggttttatctttagtttctcaaacgcgtcccgcctgtggaccggccattcaattatcttttctatctcatgcttttcagcatcaagaccctccaccatctcccagggaacttcaggaatttcaatatataattcccgcattgcagagggctcaatcccttttcttgattcctgaaagtcatgattggtgatcattaatgaatcgataatctctggagggacttcctcatcctccctcatccggctcatgatgccccgcaatgaatgcatagccgcttccttacaatgcagtgctatatcggccccgacaaaaccataactggtctctgcatagtactcaagatccacgtcatctgcaaggggcatggtacgggtgtggacatgatagatttcaagcctcccaatccggtccggaatccctatctcaatctcccggtcaaacctcccgccccgacgaagagcaggatcaatcgagtcaggcatattggttgcagcaatgacaaccacctgaccgcgggaggcaagcccatccatcatggtcaggatctgtgcagtcacccgtcgttcaacttcaccggtggtatcctgccgtttcgttgcaatggaatctatctcatcaataaagatgatggatggtgctttttgtctggcttcttcaaaaatctcacggatcttcttctccgaatccccataatacctgctcatcacttcaggaccggataatggaatgaaatgggcatcaacttcacttgcaaccgcccgtgcaagcagggtttttccagtcccgggtggcccgtacaggagcactccttttggtgagtcaataccaagacgttcaaatattcgtgggtagcggagggggatctccaccatctcccggataagactgatttctcttgaaagaccgccgatatcctcatagtgaatagataattcctcgctcttcttctcctcagtctgatacggggtatcattcagaatgacttcagtggtaaacgtgacaaccccggtaccccgtggctcaagacttgatacaatgaaggtaacggtatttccgataagatctatcctgactgtctgaccctcaatcaccggtcttccacgcaatttttttgcaaggagaacctcaggattattaagtgatatgctggtaaccggctgcaggattactttcctgacatcatgaacagcaacacgtctgacaattacgcggtcatcaataccacagccggcattacttctaatctctccatcaatcgcgatgtcatttctgccttgagtggtgctctgagaactccatgctgctgcaactgcccgctttccaccaagaatctcgataaattccccatttacaatgccaagagcacgcattactgccggatgaatccgtgcaagcccttttcctgcatcctcttcggcagcacgacggacttcaagtcgaatccctgatttagcagtcatatttttcctgagagcaccgataggttgaggtttctgttacaataatatccatcctgatatcatggtcctgaaccggaatagtaggaacctcctgaactgaataggcaacccctatccttttaatatgaggatgttcggataaaaaacgatcataataacctgccccatacccgattctccctcctgatctatcaaatccaagcataggtattatggcacaggttacatggtgcggatctgccggaagttcgcagcctacaggttctgggacatgaaacgtgctaggttttagtacatcacgggtattgatgtatgataagcgaagaccgatatcttcttcttcaatgatagggacgatgacttttcgttcttgatgaaggagatgatcaataaaccaggcggtctcaacctccggctctttggcacaatatacaagaaccgtctcacagggatgaatgacctgcgagagagtatgacagatctgacgactcatttcctttctgatatcttcaggaatactccatctccgttcccgaagatcagaccgaatagcttccttttgtgccagcataatactcttacctgatatactcccagattgcaaataccagttcaatggagatcagtatgataattatccattcgagaaagtttgaatgctgaattcggacttcatcagaaagcatcgagtagttttcctgaatcacatctatcttccgatttacactatcactccagagctgacttcgcaataccttcagggcagttgcgtacactctggcataatagacatcttcagtcacctttatgaggttatttactttttcggtaatttctgaaacttcagcatggatttccatcagatcagacatgatctgatgatacacccgcatccggctgagccatgtcagtcgatcagcacgttcgatatcctgatacatcttctccatcttattggagagttcctgatcatagtaccgaagctcaaatacctgcacatttgcatattcgataagatcaaaaaggtcagtcgggacttctggattttttaacagagcggcgttccatgaaagaatggtgagatcttcttcagtataactcaaactgttcttcaaaatttcctctttcatctgatgagagaaccgtgttttctcaccaaggagaaggactgcgggatctatgagttcttcatggttatttgtgaaatatataatgtaatcttcataaaaagtatcatcaatcgcaatatctgatatatgaggccggagtatctctttcagagtatgtaaatatgatgagaagaggtctgatattaactcctcattggtaaaagaaaggcatatctcttcgaagattccttcatccttatctgatgattcatagacaaaacaaaggctaatggccccgatatcataaatcctcgccgatactaatagatcgtaccgcaccccgttcatggtaacatcagtcggatgcatccgaaggagaagcggaggttcctctatcctgatagattttggttttatcctctgaaagttcgcccgggcagtataataactcctggcgagggcattctcgagaagattgatgtcaatctcctttccaacatcgtatattcggaaaaagcgaattgcatccatctaactatactccttataaaaacatttatgaaaaatatactgatacatacattggacaagatcttcctgatggtaccgggtataattctccatgttagatccgttctgatagtttaatataataatatctgaagagagaatgtatgattggtacactcatacttatcatcctgtgtctgatcgtgcttgtcgtactctggcaccttttgcaaaatattgtcaaattagttattaactccatcctgggcctccttttacttggaatcgttaaatttctcaacatattccccttgttggggtttccggatattgaaataggatggattgcagtgatcgtatgtgcaatcgcaggaatacctggtgctatcctccttatgatccttcatctatttggtctggtataatctttttttaaagtatcacaggaattaccagtatcggtgaatgaatggtaactccttcgtgattatcgacagttgctttgaagtacagatatccttccttttcaggcagaactggtatgatgatctcttcagaaggtaaaacagatgagatctcatcaaaaagataccagtcaatactgtttgtagaagagtatatcgaaagatgcaaattatcagcatctatgctgtcaaaaccagacagtacaacagatatggtaccttcttctaaaactcgtgccggtacaggggtagcatttattagtatctgacccggagaagacaccggaacatccattacttcgtcagattcctcatcaagaggggtaaccgtaagaggaagcacatttgaatatgctgaaggtgtggttgaattcccctctcttttcactgccatcacatacatcccgggggtaaaaggtgcgggaaccgtacattcaaagaacccatatccatttgtcagtattttactactgttcgggtactgatcccagactttcccaccaaaattataccatacaagatccagtgccgataagaatccgggttccccctcctttttacaataccatccatagagagtgacattctgcatagattggactgatgtattatcaataaacgcatcaattgtctcagaggtatggactatccgggcaggtgggttcatcgctgtatcagatgggacaaggaataccggatcagactgatattccggttcattcctgttcttccggtagagaagtgaaaaagagagagagtcagggtctgtcagatgaaatgtggcattcattgtcccgtctttcctggtttgatatatcactggttctccagtacgtgacaatccgacttcaggtatgaatgagactttggcatatgcaatcggacctccatctgatctgacctgtcctgagaatgataccgcttgtccgggtataaaaccagatgtattggatgttaggtgtaccataattccccctttcttatcggaaggtgtcacctcatgatcacctgtcccgagatacctctcatcaggttcgaaagatgttgtagtatcagattggatgcaggtaatctccagtctctcacttttcatatttttcgaatttactttctgatctggttcgtatatggcctggtaggaatatattccaggttcagtcaggaggtcggtaataacaaatatccctgaatcattggtacttgtattcagataagaaacttcagagctgctgttttttcgttcaataataatatcagaacctgatagcgggccaaaaattcctttcagaattccggaaagaacaatctcatcacctggttttctataatactggtcaggttctatgttcagagtgagttctgctgcaatggtgtaatctttatcttcaccaattgcgagtatctccttccatttatcatgagaatatggagaagcggtaattacacatgggattgcatgtaaaaccagcagaataatacaagcaacttgaaaaaaatgtatccctttcatgagcacaccaaaatatcagttcagcccagataacggtactgggtatagcgggattccaattctgcaatcgatttcggaacaaaaatatctgatctcttgttcatcttaatttttatctcatgcactctgtctggtttcagtctcatggcattttcataactctgaataccttccgtatagagatcctgatttcttaatcgttcatccgctgaaaggccggcggttggaattgtcaggagggcaaatatgacatctccgcgtttttcccagatgagagaatctaaaggatttaatgcaagagagttggtataccgttcaagagcctgaatatatctgctttgatcaagtgcagcatccccggcataagcaaaattaatggccgtttttggagttatctgatctatctgatggtacgtctgatttgattcatcattccgatagagcgcttttgttatacgtgctttacgaagtaaatagtcaatattttcaggatcacgggctattgccccgtccagtgcggtaagggtatcttccaattttccaatcctgtgaagatatatcgcttttttaccatagtattctgcgacatcaggataccgatatataagataatcatataggtcaatgcaggtgtcataccggcccagaagagatgagacatcaattaaaagatgggcgatattttgcctgatatccgcagtattttgtctgacatctgctggtagaatattttctatcccttcaagaagaagtaccggagtaattactgcaaatattatgaaaacaaccagaattattattggaatggtaataagtctcatagtacccgtacatattcacgataacgtccctgcaatcacacaaaaatattctaaatctgcttagatccaaaacctcatcatatttctgctcctcaatatataaatgcggcttacctgctctacctttaagtgagcctctctttacaaaatcttaggaataaatctatgtaccggtagtcttataggcacggtaaacagatcagaagctagcaaaatgggtgctgttgttatggggtattatcgaatgcagggggatgagatatgagaattttacaatatcttaaaaaggaagtcattgtactatcaattctcattggagctgttgtatgtattctgttctcatcgcccgtcttctcagatcaggttattactatcgaagatacgggaaattcttttccattgtatgactctgttcagtaccagatccaggataccatacaaaaggaagagacggaagggaggagacttttcatctcccgtccttttggataccttgaatgcacagaagacagtcaggtcaatctttccatccggaagacatacatcgacagggtggccagagataaagcctatataaaaggcgaaattagaaatctagatgacaaaactattgatatcatcgtaatcacctttaacctgtttaatgctgacggagatcagataggcaacgcctatgcaacgattgattatctggagccgaaaaaaacgtggaaattcactactgatccaatcacccgttcagattttaaatttgaacgatatggatcagtctttaccggtgtgtacgactaaaagaggagatcagagatagagggaacgcaattttttacttaccctttccacctgttccaccgatgtaccgatatacgattccggattaagcaatttctcaatttcaggtccggggatatatttcgtcacttcaggagtcccggtgaggagcactgataatggtttttgtaaggccagtgcctccatactcttttccctgataatttcatgggcttcctggcgtcccatccccttctttgtcagttcaatcataaccgattctgccatattaattccatgcagcatgccaaggttctgttttatccgatcttccttcaggttcagaccttccagaactgaagtcatgatcttcaggatgtggtcggtgaggatggttgcttcagggaataagatccgttccggagaagagttggttaaatcacgctcgtcccagagggtattattctgaaatgccggctctactgatgaccggattatccgggcaagaccacaaacctgctcactttttatgggatttctcttatgaggcatggtagaagatccgacctgttttgcaccaaaggcttcttcaacttctccaatctccgttctctgaagggaacggatctcaacgccgattttatccagagttgtggccagattagcaaggaaacagaaatattccgcataccggtcacgctggataatctggtttgaaacatcaaccgatgatatattcaggtatttcatcatctgttcctgtatctccatccccttctcaccaagagctgcctgggtcccgactgcgccggtgagttgcccgacacagacccttggtctcatttgtgataatcgctcaatatgacgtccgatttcacttgcccatatagcaaaacgaagtccgtatgtggtcggaacaccatgctgaccatgcgtccttccaatacagaccagatgccgggtcttttctgcccggtcaagaagaaccgcgagtatcttttttaatttggtttcaagaatgtccagcgcatcgcggagctgaagaccggtagcggtgtcaagaatatcatttgaggttgctccatagtggatccatcttcctgcctgaccgcatacttcagaaactgccctgactactgccatcatatcatggtgaatctcttcttcaatctcttttgagcgttccagggatgcactgcgtgctttctctgcaattatttctgcatcttccctgggtatcatacccagtattccttctgcatgggcaagggcgatctcagcttcaatgatgcaccggaaccggtgttcctcactaaagacctgtttcatctcaggggtgccatatctgaattctatcggatggatagccattgtgtacctgttggactccatgctagttaaccatatgaatccagatgagggcatatgaaaaacacggcatcttatatagactgaaatctctcaggtgatgatatgataactgacagggaacgggcagcttttgaagcaggaataaaacttggtgcattataccaccaatgggtaggcgttccggtatcccgagagtccgcatcatcattagagaaagcgatagaaaatgcgcacattcagcaaccttatatgaccgatattgcagtgcgccttgatcgggaacttatgataccgaactcattcggatatagtgaattatcaggtctaatgctggatgtggaactgactgtacgggtcaatgaagcatcatgtcatgcctgtattgcacgtgaaggtgaatatcccatgatgagaattgagtggatagatgaagacaccgaaatacccaatccttgatgatcatatccacatcgatcccagaaacgggaaagggatagaggcagtaaaagagttcaagcgggcaggggggactcacatatgtctggtaacaaaaccctcctggtcccttggtatccatccggtccggggagaagactttaggggagtctttgatgaaacgcttcagatagcacaccagatccaggagcagaccggtgtaattgttttccctgtgttggggtgtcatcccgcagagatcacggtcatggctgaacggatgagtgttgcacaagcggctgacatcatgaaagatggtcttaccatcgctgcacaatatgtaactgaaggtaaagctatcggacttaaaagcggacgccctcattatgagatccgtgaagagattaccgtcctttcaaatgagatattatcacatgcattttcacttgcggcagatgctggatgttctatacagatccatgcagagtcaggtccgtgtgcagatatgatagagatggcatcttcccaggggatgaatcctgcccgcgtcattaaacatttcgggacacctgataccccgcttatcccctctcttgttgcaaagcatgaagagatcccaaatctgtgccggttgaaacgggaatttaccatggaaagtgattacatggatgagaacagccggccgggtgccgtcatcggtccaaaatcggtgccccgttttacccttcggatgctggagcagggaagtattacagaagaagacctgtaccggatacatatgcatacaccccggaaggtttatgggattgagatcgaactctgatacacctgaaaggtttttctcgtacaggggcacgataatatcaggatgttacttagaattcaccggtcggcagacaacaaggaagtaatagggttatgtgaccgggaactaataggcaggaccttttcagaaggggagatatccatctctattaatgaaggcttctttggcaaccagccgacttctgaagaagaggtcatccgcgttttgatgaatggtgataatatcacgatctttggaaaacggtgcgttgaccttgcggtctctcatgggatcctggaaccggattcatgtcgccttattaacggcatcccgtatacgactatcattcgaatataaaaaaacgatttacatggacttacaagaggcaatctgtccgaaatgtggtggcccgtcaccaaccggggatatctgcgggaaatgtcgcgcatcagatattgaatggtttacctgtgacggccgtgtccgactggtacgttgcccgaattgtaactctatgagggataataacggttggaatgattgtgaacgatcacgtgaggatcttgaatatgaggctgcaatttcggccattcatctctttcaggatgttcagaaacctgaaatctctataaaattggaagaaaacagcaaaaacagaacttttgcacatatatccataaccggtttattatataatgaaccccgtgagggggcctgcacggtagagatactctggcaatttgactcctgtgaccgatgcagcagatatcacggtaactactggcagggggttgtgcagctccgggctgatggcagaaaggctacccctgaagaacaggaacgtgcaaaacggatagcgtaccaggcagaagaagagttacaactccagggagatcggttatcttttgttacccggatggaagaagggcgtgaaggtcttgatatcatcgtcgggacccagacgctgggtgaaaagatatctcgggatattaccaggcggatgggagggaaattctcactccaccctacccttgtcggagagaaagaaggaaaaaaactattccggattacatatgcggttcgtcttccacgatatacgaaaggagatatcatttttatccggaatacctatggtgaaattctgggggcagaggggaagactatcagttacctggatttggcctcaggaataccccgcacagtccctgaatccacccagtccagatatgtcggatctgtacgggacggaatacccatgctagtcatatatcaggatggagaaatgctgggtctcatgaatgaagagactggaaagacagaagaagtcccggttcagtcatggcggaccatcgtctccggagaacgcgtacatatcatccgggatgaagatcgggttctggtagtctgaacaaatgataatatgaatgtccgggagatcccctgcagggagatgaagaaaatcctttcagacccatgggtagataccagcagaaaaccctgggtatcaggagatattgcgtatgtcccggtgcagaaaggatattcatatactctgactcttccagagcggcgaagaaaaggcagaggataccagaagataggttcaattatcgcttttcatggtgaacaacctggcgcagacgtcatcgatgaagtacgaaatctccatcacccacaggggattatctggtaccggggccaccatggagagatgcggattcctgatattgttcttctttatggagaggtttctgacaccatccacaaggagtcaggtcttttatatcacctcaatccgactaaagtgatgttttcacagggcaaccgtgaagagaagcagaggatagcaaatcttgtaaaacctggtgaacagatttgcgatatgttcgccggtatcggatactttacccttccgatggcaaaagccgggggatttattcatgctcttgagataaatccggatgccgtgcactatctggaaaaaaatgtcagagaaaatgctcttgattcacgaattcgtatcacaatgggggactgcaggaagactatcaccgggacatatgatcgcattcacatgggatattacgaagcagcaggatttctggatgccgcactagcacatgtcaaatcaggtacggtacttcatgttcatgggatcggagataataccacagagattcaggagcatctgaaaaccttcggacttactgcaaccctcgcacacaggattatcaagaaaatcgggccagggaaggttcataccgtgactgatgtggtgatatcatgatcctgaatgggaaaacaattcttatcggagttaccggaagcattgctgcagttgagaccgtccgtctgattcatgccctgagaagaaaaggagcagaagttcagccggtgatgagtcaggcggcttgctcgataattcatcctgatgccctgacctatgcaagtggacgggagaccatagtccggatctccggccatgttgaacatgtcctatactgcggtgatgaggggcgtgctgatctttttttgatcgccccatgtactgcaaataccatatcaaagatagcctgtgggattgacgacacaaccgttacaacctgtgcaaccactgctcttggaagaaagatgcccatcatcgtggtcccggcaatgcatcatgcaatgttccggcatgaaatcgtcatgagaaatcttgctgccctgaaaaacatcggcattgagatagtgggaccccggatagaagaagggaaagcaaaaattgctgacatcaacgagatagtcctctggtgtgaacggcttttatcaggcagaccacttgccggaaaacatatccttattaccagtggcagatgtgaagagccggttgatgatatccgggtcctcaccacccgttcttccggaaaaatgggtcgggaactagcatatgaggcttttcggctgggtggtgatgtaaccattattcaccgggatgagatacatattggaagaaacatccctgtcaccaccgcgtcatcgatgggagatgcaatcaggtcggtgatggaagaagagataccagatatatacatcagtgctgcagccatctctgatttcgctccggaatgtatatccgggaaaattcccagtgggaaacctgcaacaattcaccttcgtcccctgccaaaattactggatcttactcttggaaccataccggtcacggtcgcattcaaacttggacaatctgcacatgaagaagcagaacaacttctattaaaaggggtgaccatggtctgtgccaacaaaccggaaaatctgggatctgatgatgcccagtatactattctggattcatttgggcagaagtcaatagcgggaagcaaacaggagatagccacgcagatttatgatcgaatcattgaaaagcacctgtaatcatggaactgacacgcgttactgccttttgccccggtcatatctccggctactttctcccggttatccacgatgatcctgatttatcgggaagtatcggagctggaattgtcatctctgaaggtgtcagggttattgcagagaaaagtgctgattctaccgtgaagatatttcagaccgaccggtacgggctgccggaagagatagctgaatcatcaccagttcttatggatcttcttgcatatatgcaggtaaatgcatcaatcgagaccttttgtcatctcccgattgggagcggatatggtatgtcagctgccgctcttttaggtacggttcatgcgctgaatgctctgtataacttccatctctctccccgtgagtgtgcccggattgcccatcggattgaggtacaacaccagtcaggactcggggatatttccgcatgtcaggggggaggatttgtcatcagaaaaacccctgggcctgatggagatatcatgcgggtaattgatacccgtcccatttatgccctgaccatcagtcctataaaaacctcatcagtgctttcatcccatgacatgatagcacagataacccagtcatttccttccaggataccacaaaatctggatgatattatgtctctttcacgggaatttgctgagaagagtggccttatttccaaggaaatcagaaccgtccttactgcatgcgataaagaaaacctccctgcaagcatgactatgctgggatgcggggtatttgcactcggaaaaagagcagaaacggttctgaaaaaattcggagaggtatttaaacttacaatttcacccggaggtccggcaatattatttggagaacgatcttcatgataccagaatctcatcccaggtataaatcactgataacacgggaaaaactggctcagtacaccaaaaccggaatagtatcgcttgaaggactaaccgcccacggaagaggagaggcttttgactacctgcttggggaagagacgactgaatcggcactccgggcagaaaaaatagctgccgctcttcttctctctgcaaaccaccccgttatatcagtgaacgggaacaccgctgctcttgctgcaaaagagattgcacagcttcaactggcatcaaaggcacgggttgaagtaaacctgttccatcggacagatgagcgggtgcaggcaatatctggtctcttaaaggaacatggtatcacgctggtagaaggaactgtctccaggtatattcctctggatcatgaccgggggctctgccactttgatgggatgcactctgctgatgtggtactggttcccctggaagatggggatagagcacaggcactaatcgatctcgggaaaaaagttattgccattgatttaaaccccctctcccggacatcaaaggttgccacagtaccggtcatagacgaggttacaagagcacttgcaaatattgcaagattctgcaccgaacttgatcaggatgagataaccgggcttacacgtgaaattcacggaaccggatttatcagggatgcccttgaatatatacgggagaggcttttgaatgttctggattgaaaaatatcgtccggtcacttttgaccagatacttggtcaggaacgggtgtgtgaagtgctcaggcgatgtgccgcaacaaaaaacctcccacatctcgtagtatccggcccaccaggaacagggaagtcagcagcggttgaggttaccctgcgtgaattatacggagatacctggcaggataatgtaaccatcttcaggacctctgatcttatggaacgggggaaatatgcgcttgaatcagatgaacggtttttacatctgtaccgatctgatgaatcatttctgtcaaacttcaaacatatcatctcttcctacgcttccatccgaccgattaatgcagagttcaaagtaatgttgtttgaagatgcccatgcgttatcacatgatatccagcatgctctccgccggaccatggaacggtatagcaatacctgccggtttatattttgtacaacacaggcatcaaccctcatccctccgattaaatccaggtgcctgcctctctttttcacccccttatcccgtgatataatccgggactgcctgaatacgattcagaatgatattccagaacctgatcgcgtctctgatgatgagaccggccttattgttgctgcagcaggcggggatttgagaaaggcaatcatgtatctgcaggtcagggtggagacgaaaatccctttcaatcctgataccttaagcaggactgatacccaggaagaggcctgccttgcacttcatgctatgaaagcaaaagatattgtcgcggcccaaaaacggctgcaggatcttatgattactcagggactgtctggcagagagattatctccacccttctccaggtcactgaacgcgaatataatgatccggagattgtgacaaggcttgccgatactgatgcccgtctgacccatgcaggaaatgaatatctgcaggtcaatgccatggtagccaccatcgttgcggaggtgttttcataaccagagcaaaattatcggtacatgcccgggtgcagtcgcattatgatgatattgctgacgtatatgaccagcggtatgaccaccgggaacgtggcaggatctattatgatcatatcgccggggcagtactcggcaaaatcaatccctcaggacatcttcttgacattggatgcggtacaggactattcctcgagcgatacctgaaagaaggaacagataggaccgctactggtattgatatcagtccggggatgatcaaaaaagcaagagagagatatcctgatctaccctatgtagtgggaaatgcagagcttcttccctttgaatctgactcctttgattccatttcaagtcttctggccttctcataccttcagaacccggggcagagtctgtctgattgttatcgggttcttgttccaggagggaggttggcagtctgtacgcttgggaaaaatatctttacatcaagccttccggccctttactcaattggagcgaagatgaagatacggcgggttggcgtgggatcttttgccgaacactattattctgcaaaagagatgtacgatcttctcgataaagcagggtttgaagagattgagatatttaaatgttcatttgctcacttcaaccttgccggcccgctcttcatgatcgcaaaaaaagttgaatcctttattgaagataacatcccctatctggcgtacaacctgatagctgcagggaaaaaacctgaataaaactcttctatctccttgtaattacttccctttcaatttttttgaaagtgcctcaaatgtgtattccatctcataatggcagcaatgtttcctgggtaaccacaaaaaccgtttttgaaattcaacatccgcccgggtaacatgcaatgccagagagagctgaaaggccagtattacaaacacggtgaggataatatcacgaagtgtaagcgaaatggttgaaaaaaaggagtaatgagcggtgattaaataacgaatctgatcctcaagtcctgcaagttgaccgattgtgacggctactatgattattaaaagcccgaataacaggatcatgacacaggaaataatccaggaacgaaggaatctgccgataatcgcaacgatggtgcataaaataaaaattatagcaacagggtccgtcagtgcctgaattatcgtattatccattgatgtaaaatccaccggcatcaggtttaattttttctatatttttgagttcatcttttttagaaggcacaggtcacgcacattttatattcattaccggaaaagtaacaatatggttcagtcattccattcttgttgggtatacagactctttttcagcagaatacaggagtttacatgaatcagcgattttgtatcgggtttgaagttcatcagccatatcggcttaaaaaaggattcaaacctgatttcgcggacggtccggatgatccgatggagcgctacttcgatgacgccaataaagagatcctgctccgggtatgtgataaatgctatgaaccggctacatctatcattcttgatcaactggatgacggtttttgctgtgcattctctctctccggagtacttatagaacagatggagaaatgggcacctgatgttcttgatctcttcagacaggcggcacagcataaaaatgtcgagatgatcgggcagacctattttcacagcatctccagcctgttctggaccatggatgaattctgcaatcaggtgaacctccatcgtgacctcctcaaagacgtgttcggagtaactcctcaggtatttgaaaatacagaatttctctttgataaccggattgctgccacggtaaaagatctcgggtttaaagcctgctttactgaaggtgtagattatatacttgaatggcgaagtccgaattacctgtatcagtgtgccggtctaccggtcatcatgcgcaattttaaactttcagatgacattgcgtttcggtttacctgccgggactgggaagcctggccactgactgctgatcggtatgcaaactgggtctcacgaactccgggtgattttgtaccggtatttatcgactacgagaccatcggtgaacattactgggtagagtccggaatccatgaatttttcagacatctgggtccggagatgagaagatcagaggtccaaatggtaaaaccttcagatctgttatccttcccggtacatgatgaattttcaattcctctccccatctcctgggccgatgccgaaaaggatggtacagcctggattgaaaaccgaaaacagaagaatgcattcagatcagtgcagcgtgcagaatcattctgtaaagataaacatacctggcggtgtatgcagattagtgatcatttctactatatgtcatgtaaacatggatcgtgtggagaagtccatacctacttcagtcatcagccggaacatgaagcatttattacctatatggatgtcctggcagattttatcgaacgctccatacccgaaatggacaaaaaggagtacctctatccactccgtaccattccaatcgataatgccttctacttctcaagtccggtcggatacaccggtcatgtcgcctttgatatggatcagtttgccgatatgcttcagattgttccatcagactcgatcacatatcaccatcagaaaggcgattttgccagctggtgtcggaatgtcataaaggatgagccactggcacaggctatcgaaaaagcccggaaccggcaggaactgatactggctgcagatacccgaagacatgaattatggaccgctttaaaataatttaaaataccttctttccaaaaaataaggaagatggaaggatctgataagtcaccgttccattctctccatggagggggtaagagtaattctctctatccagaataagcaattcattatttatgtggttgaagtagggtcacgtaaaacaatatatcggaaatatttaggttggaggatagtaatgggtacttccttacaggtatcctattctgaaaatattcctgcagcttgaatgatgcttctgaagagatgaataccggtctgccattataatttgaatttttgagcgcgggatgatgctatcactttttccgacttaatttccacccggactgaaggttgttatctgtacaggggatgaaacgtgagtaattacatctgaatatgcggtacaatctctggtataatccggcatatcggatatatttttaatagaaagatcatcaattctttgtatatgcgtagttttccgctcgtgttcttgatggacttttcaaaaaatttcaaaaacaccgttcatcccgtgttcatatttcgtaatgctcacctgcttactggaaaaatcacttcattcaccaaaagacaggatggtgatgtatcatgaccggtcaccgctttaaaatagcaattttctgctgggaaaacctgtacagcgaccgggtcggtggcctttccaatgccgcgacctatcttgcccaggcccttgcaaaggatcatgaagtccatttcttcaccagaggcgatgaagactttgaaatgaataatgtatactaccacgtctaccgcccgcatggaaataacatagttgaatactgtgcagacctttcaagaggtcttgttaaccggttttatcaatatgatgaccctggttttgatatccttcatttccatgactggcatgtaaccgaagccctgcatctcctccaggaccggccgacggtattctcatttcattcaacagaatacggaagaaatggaaatgttcacggggactggtgggagtaccatgagatatgcagcaaggaatggtatgccagcctcattgcccggcggtgtatcatggtatcatggacactccgcaatgaagtgcttgaactctataagaccgatccaggtaagatccatgtcattccgaacggtgtcgtaaaagaacagtttgacgtgagcattgatcccggtgccatcaaagcccagtatggtcttcattatatgacaccgctcatcacctacatcggacggatggcataccagaaaggccctgatattctcgtcgatgcaataccccttatccgggaaaagcactggaatgtcgcattcatccttgccggcggaggagggatgcgtgactggcttatagaaaggacaaaaggatggccggttcagcttcccgggtttatatcagattcagagtatgtcagactcctgcatgccagcgatatcgttgtaattccaagcaggaatgagccatttggtatcattcttcttgaagcatggagtgcaaaccggccggttgttgtcagcagggttggaggtcttgctgaaaatgttgagcatggagtaaatggtcttgttgtggacccgaatccggagggaattgcatggggtgtcaattactatcttgacaatcagcatgatagaatcagattagcacgaggtgggtataaccaggtagaccggagattcttctgggattcaataaaagatcaggtgttgtatgtgtaccgcgaagcaatgcattgaacatatcctgccgtatatagataaagtcattgactggccatggaactgacgttcatccctcataccatcagatacggatgaaagcttgctaatcccgctatcgcatcggcacgactgaaataaccagcatggaacatgatctcatatcagtcagtccgtgttcaacctggatagatacatccattactccacggaaaggagaccggttgaagtaaatactctctgggtactggctcttgaggtgtgtgagtaccttgagataggagtccccgtcttatccaaacagtaagacggtccttttattctttctggaatgaagatgccggatgcatgtatgatgtctgcgatcctgatgatgtatccgagaccaaaccttatcgccctggctcatggcccggtacatggatgcactcatacaatacggtgaacaaccacgacagatatcacgggtattgcaaccgctctggcagtacttcctgaccgatggaatagaaatacttcctgatacatttgaaggttattttcaaattgctcccaagagagccatttgtttgacaggggtatttcagaattaatcagaggaagaaatgcaattctttcttcaattaacccattggatgtcgagtaacacctttcatttatatgcgtttttcactttcaccctgtttcctttactcttatatgggggataccaggatcctgctatgccatgtcagttcctctcctatcacagttctcagtctctcaaggtacattcaccgctttcattgcaccagtggaggatctgacccaagcgcccggtttatttctaagaaaagaaccaggccttattctctacctgtgcggtaattatccggtgatcctgcctgacttaacccggtattcagatcggtttgttgtcagaagggctcttactgcctttcagatcctgacaatcctggatgaagcataccagtcattccttatcattgaacatgatcggtcgctctttgaagaacgtgcagatcttcttcccatcatcggtcaacggtgcagggaatatgcaatgaaaaatgccggagtccttcttcttgctccctatcctgatatgtatatacaggcacttgagccatttttccaccggatattcctggttgatcatgtgcagggagataaagttgtaaagaaaaaacgaacgaaatcaaaacagatgtccctggaggtttgagatgaccaaatcagacagttcattcctgttggatattacccggaccaaaaccggagtggatatctgggagaaaacaggtggtcagctctcctgcacccatcactcccttgagcagggttttcttctttcttttccggatagtcatcagttttaccagctcctagatggccttgctgacgaataccccgttactccataccggattaccaccatttacggagaagaggacggataccgggttcaggccgggagggatgttgcacagaagatagaagaacagaccctgtaccaggcacgactgtttaacgttgatatcaggcctgaacagatcttctgcgcacacacaaaaaagatagttggagggtttcaggatgcagatcggttctctcctgatcagaaagcagaccttgatctgatggagattacctgccgggaaaatcctcaccggaatccccatcctgaacacattaccatcatcaccagcgcaaggcaatggatacttgacgggccggagcgcactattgcagaagatctctttacgataatccaggataaggacccggatatcatactttttcctgattatgacacatggtccggaattttttttggaatagccagggagaattatctgtttaatgcgttcagcagaaccggcaggtttcacactgttgcacccagatcctatttcagctatggaagaatggaacaccggcttggggcgaagattcctgaaggccggataattattgacaccaagcagagtttcatgtaccgtgaaggggatctccggggaatttttcttgcatccaggcttgccgggctttcacccaaccttacctgcaggctcacacctggcacactgatctcatcatatgaagtatacgaagcccttgcccgggggtatgcagtccctttccggaaaagtgatgcagaggcatgcagaagagtcacggcaatgagacttgattaccgcggaggatacatacttcagcctccaccaggtatatttgccgatgttacccagattgactttacctcattttatccgtccataatcgtcagtgaaaacctctctccggagacattgaatgaccggacaaaacccggatttctttcatcagtgttggaaccggtcattacgctccgacaacataccaagcagatgaaaaagactgatccatcctatgcagggatggacggcgtattaaaatggatgctggtcacctgttttggttataccggttataagaacgccaggtttggaagaatcgaggtccacgaggagattacccgtgccgctacccggatattgaaagactgtgtgaaacttaccgaggcccatggtggaaaagttcttcatgcaatcatcgactgtctgttcatcaggggcggtcatgcaggaaccatccaggaagagatagaacggatgacaacctttcatacggaggctgatacctatgactgggttgtttttcttccccagtctgacgggagcgggtcctactgctcttatttcgggcggttgaaaaccgggaagatgaaggtgaagggagtttctacaaaccggaggaccactccgccctatgttgtcaggatgcagaatgagatgtttgatatacttggcacataccaggaaattgatggcatcccggatgcacgggacaccctgtactctgtatacaggcggtacctggataccatgaaccatgcagatctcagggattttatcatcacaaggcgtatcgggaagcacacctacaacaaacaatgcattgcccaggcggttcttgatacatataaggagcatcatgttaccatagagccaggtatggatgcctcattccttgtcagggatgagaaacggctcatagtggatccttcctgggacgctcagggtattgatacacggtattataaaaggctccttgacaaggcttatgaagaagtggtctctatgcttccctgaaccatgggattcacatgctaagaatatcagagaggtttttgggtaaggagataatcattaccggacaagaacctccctgaccataccatctttgtgagggggaaaaaagaaattttaacagtgatgatactactacactaagagtcgaagataattcccggcatctgaagataaaaaatgactcgtgttttatatatcgatgatgaaaaaaccctccttactcttactcagatctatctgagagaggaggcaaatcttgatgttgaaattgcagcatcagctgaagaaggacttgtacttctgagaaatgaatcatttgatgcgataatttcagattatgatatgccggatatggatgggattgaactattaaaatgtgtgcggaaagaaaatcctactatcccgtttatcgtgttcaccggaaaggggcgtgaagagatagtcattgaagccctgaattacggtgctgatttttatctgcagaaaggcggagatccaaaaccactctttacagaacttgcaaatgctatccgccatcttgtcagaagaagtaaggctgaagattctgcagtgcagcatatgcaatactggaagaatgttcaggaatctataagcaggaagttgcaggatattgaaaattctgctcaggctttaacgaacattacagaagatctccctgaaagtcaggaacatatccggaagatccttatgcgtacacaggaaatccatgaagaactccataaccagtacaaaccggagatgaaataatccatgagtcctgaaggtgtcatgtcatcgattgagtttcagatgagtctgcttcttttcgtggccctggccgggtatctcctggcatcccgtatcaatcagtctgcagtcattggtgagattcttgtcggactgattgtggggccaagtatcctcggtcttgtgacatacaccgattttgtaagcagcatcgcccatcttggcgcgattattcttctgtttgttattggatttgagtttaatatccatgaaatttttaacataaaatatgggtttattgcagcttttggagttattgttccctggataggtggctatgccacggctcttctgtttcattttaatatgcagggagccttttttgtagggactgctcttactgccacaagtattgcgataacggcaaatgtcctcagggaaataaatcagcttcagtcagaggctgcaaaagcgatcatcggtgcggcggtcattgatgatgttctgagtttactggctcttgcaatcacggaggattttgtctccgggtcattcaccgtggagggagtcgtattagtctttataaaggcaattggatttatgggtatcttcggccttcttggtgtatcggttatcagcaagttcctcatgaaacttgaccattcaaagattgccgagaagtttcctgaattcgtttttatcaccgcgatgatgatcgcattcttctatgccatgatggctgatctggtgggtctttctggtattgttggggcatttcttgcaggagtctcaatggagagtgtgggcctcagacatagcaaggacttaaaggaaggtgcagagtacctccagatcatatttgcatcgatattctttgtctctcttggtattctggttgacatgcatgctctgacactggatggtatcatcttcatgctggttctgacaggtattgccatactaacaaaggttattggatgtgcagtaccttcccgtcttatcgggatgtgcacaaaggattcccttatagtcgggtttgggatgtcacccaggggggaagtagccatgattgtcgcccttatcggacttaccggtggaattatcgggcaggatatctatgcaggcattgtctttatgagtcttttaaccactatcagcaccccgatagtataccggaactggctataccggaaaacaccctgtattgcagaaaaaacagaataaaaaattacccttcaaggggtatggtagttaactttaccgtttcaacacctttttgagccataagacgctcggcaatcccttttacctgctgggcatctccctttactaaaagaacttccacacaccggttgtgagtcacatgggaatgcagtgaagcctgaattaaatccatgaagtcatgctggatatcggtgattgccgcgacaagtccgcgttgatggtgatcatagactaacgtgataatgccctgcctggggccggagagatcagccatccatttatgatatctgatatacgaacgaatggcatcccgtataccttcagatctggaagaatatcccctgtttttcagaatctgatcaaaactctgaagtaaattcgatggaagtgatactccgatccgggatagatcatggtcatacaaatcatcctgttccgaatcagcgaatgagggagacatgatgattactatttatgtaatctggtatatctttttcttaccatgtatgccgaaaagatcatgaatatttaaggataagacatatcagaagattacatcagccatcaatgaaatttatcgccagaaagaaaatacgttatattactcactatttagtaaaatttgtttaaataaatactctcatagtccggagctcacaccggtttttgggcctggtacggtatgcccggattttctatatctgagtatccatacaaaacgcgggaacagttggtttttgactcgcatggtccatgtgcagggacttgcagagagcagcgtaagatcaacaaacaatgattgaatgtcagattctgaaaaataatgggtaataattccattccctttgagcaatgtcccgtcttctacttccacaccggatgttgatctgaaatcttctgtcccaaaaacggttaccagcaattcaccatccgggctgagagttcgtgttatctcacgggcagcggttatgcgatccgtgtgcagaagatgccccaggatatgatgagcatcaatattctgaatctgtgattttttaaaagggagatatcgtacatcagcacagataaaggaaacgtcagccagttcagatcgtgatctgcagaggcggagcgccgtcatggagaaatcaagtcctatccggcaggtcgcaaaagaggcggtgcgaaggtttttcccatttccacatcccaggtccagaaatattccctggtttatctgggttgtcggctcaagaggggaattcccccagagcgtccccttaacttggtactctgcgtcccaggcctgccgttgaccggttttgttctcatgaatgttacccgccggtgtcatgtatgttaaatcccttacatgagcattttccaataatgatggctgtaataatagcaccaagtgcgatgactgccgatgcggtttcaaaggatgaataagagatgatatatcctccaattgcagggaggaaggtcatacctgcataactacaggtggagtacaggcccatggcaattccctgtcgctcctcggcatgtgccagatatccaatctgtgaaaccatgataaggccggcaacggctcccatgatgaggattattaccggggctatgaggaaagaaaatagtaagggaacgatcatgagggctgatatcctgatgagcaggaccggttcgatcttcagatacggggttcctagtgatgcaatgatagtggcaaagttcattgcagcaagaacagtgcttacctcatggaccggatatcctgaaagctcaggaaacacagcctgtacatacccggttgatcccagaagaatgatcaccgaaaaccagagggggtactgacgtagcatctgcgaaccggtctctctgactaatacctgtgcagaaattctatcctgcgctcccagccggggtattgtgattatacataccataatgcagataaggcctgtaccaagagtgcagacaagagccccaagaagtatatctccggtcaccatagcaagccagcctgacccgataagtccactcaggagaccgaaattgagcgatgccatgaagagactggtatttttcagggtgtctttctgatatccaatccaggataatgcagaggagacgaaaaatcctgcaccgattccttcaataaatctccaaataagcagatcgaccggttctgtaagagtaattatgagtatgccggatatgagggtgagaaccagagagattcggattaataacggctgaccgtaccggtcacttgctaccccggcgggaagcgttgttgtcatcgctccaaaaaagtatgccgagaagataagagtctgaaacgaaagatcatcagaaagagaaggaagaatcgggacaatggcatttgataaagccatcaccatgaagactgcgataaaaagcaaaaatgaccgattcatctgtatcagattaaccggtatgtttccaaattcataggggaggttgtctgaatgtgtaattttttataaatagaacttgcaagatcgatggtcttgttctcatcaccatgaattgcaaatatcttctctggtttgggttgcatatgagagacaaaattcatgagttgtctgcgatctgagtgccctgaaaacccatctaccgtgatacagtcaaggttgacgacgatcgtctcccggttaccgattggaatctcccgccagcctttctgaattctccggccaagtgttccgtctgcctgatacccgacaaagaccaggcagtttcgttcatcagcagcaaggtttcggaggtattccatgacaggtccaccgtttaacataccgctggtagtgatgataacacatggctccccggtgatgacacgctcacgtttctctgcagaatccacctgctcaaaacactcggcaaggaatgggttgtgcccttctttgaagataagattacgaagctctgaattcaggtattcaggataggtggtatgaatcgcagtcgcttccttgatcataccgtcaagataaactttaaccggtgggaatttcccaagccgcataccttcttcaatggcaagcatgacttcctgagaacgtccgacggcaaatgcggggatgatgatcttcccgccccgttcaagaacctcgcgaaacaccccatataatctctcttctgcatcagcacggtttggctgcatatcctgtgccccaccataggtggattccataaagagtgcctctagtcgtggataatgatttactgcagcattgaaaagacggcttttcccataatgaagatcgccggtaaatgccacattatacagcccgtctccgacatggaaatgtgctatacctgatccaagaatatgtcctgcattgtggaaggtcagtttgatatcaggagcaatatcagtgacacatccataattaagtactattgagtgcttgatatattccttgacctcattcgaggaatacggaatgggttttccttccttattcaccacgtcaaggtaatcgagctgtagcatagcggctaaatcacgggttggcggggtagagtataccggtccttcatatccatatttataaagaagcggaatgtaggcacaatgatccaggtgtgcatgggtaaggaccacggcatccagctgagagagcggatgaatctcaggaacatagagatatggtgttgcttcaaaactgtctggtttttctccgcagtcgataaggacacggctttcaggtgtggaaagaagaaatgccgcacgtccgacttcacgacagcaaccgagggttgtcacccgtatccattgatcttttgcgatgacatcacgatggattctgcgacctatcctctttaagagctcttttcgttcctggtgggcggcccgtaaatactgccgtacctgctttaccgtgctgctttcgatgggcggagtcctgacaaccttgggtgtccacccgatctcacgggttatgtcacgaagggtggctccgtttttcccgataaccacgccgggtttttctgcctcaatgaggacttcaccgctgtctgcttcaaagaatatatcagatattcctgcattctcaccgacgacacgtcttattgcagatgcagcacgttcaggatcttctaatatggtgggacggacaacgatacgtttcctgatatccctggcaagtattttgataagatcatcctggtcagcaaaggtcttgggatcatcagtgtagatgaccagttcaggcccttcaaattcaacagatgatactttaatcccctttgggactttctttttaattttttcctgtatctctttgagacgttcctcaataagcataaaaccgtcctaaaaaagtgtataaaatatttaaaatagtctaatttggtgtaagcacactaatttcttcatcagataattcatgataggaatcttcagtaattacaacaacagcaactccttctcctgaccctgcatcccgttttattgcagaacgaagggcacgtatggcaagttcgatggcagaacgttcgtccatgccgagggtgtaccggtcttcaaggacaccatatgccatgggagatccggacccggttgctacaatgccatcttcctttccggtacctccgacagcgtctactgagaagagtaccggcccggtttcatcaacccctccaatcaggagttgaacatagaatggaaacatccggttcccatgaagaatatttgaaagaagagtggatgcagcctgaacactgatacgtttccctctgcggatttcgtaaaggttcgcttccacagtcatcagccgtgcaagctgctgtgcatcaccaacaccgccggcagtggtaagtccaatccggggtgcgatctggtagatcttctttgcagttttgttggatatcaggtatcccatggttgcacgtttttcacttgcgagcacaacaccggtttcaaaaacaatcccaaccgtggttgttcctttcattgtatcgctctgttcgaccataatggactccggaaataatgagtaaatggggaaagtattgcagaagcaaaaatgccttagttacaaataacctgcaataatttaaaggtttttattgatatttttcatctaagaggactttaataagttctctgtcgaagagaatacttttgagccggttatcaccgttcactatcggaagctgatctacccgtgcacgcttcattttcagggcacattcactgacttcggcatttggcgggaccatgaccacattggtgatcatggcagattttaccggacgattggggagctgaacccgtgaaatgccgtagctgatgtgatgaacgtcacggatactttcccaggtccattcatcatcatcagtaccggtagtggagagatcagatgtctctactgaatcttcgatcatagcacatctgatcagatcacgctcacagattatgccctgaagttttgattcacgattcaatataggtatagcctcaaacccggatatctccataattcgccctacaaggggcagaggagtctcttcccagagagcaaaagtagggcttgtgtatgtatctttaatctcttcctctatcttcatccgagctattgcaaggataaggtctgcaacactgataagtcccaccagattctttgcttcgtcgaggacaggcatcctgcggatattatgtgtcctcattatcctggctgcctcggtcagcgttgcgtctgaacggatcgtgagcggatcaggtgtcatcagtaacgcaagctggttttcttcaggtttgtgaagaagatcctttcgtgtgatgataccaaccagttttccgccttttaaaacgggaactccactaatccctgttctttttaaaattttaagtacatcatcccggtttccaggtatttcgacggtgacgacgtcggtcgtcatgtagtcagataccagcgggaccggcactatgatctcaccaccaacacggaaactttgctgtgttcaacaacaaaggaacttacacttccgataaggatacggtcaatattactcttcccatgagaacccataatgatgaggtctgcaccaattttatcagcggtggaaagtatcgtgtcaccggcatgaccctgttcaaaatgtgttatgacttccgtgttctttttctgggcaatctctttgatcttatcaagtgctgcattgccctcctgctcaagcaggctgtacatgatctcaagtttgctgtctgccggtatatctgtaaaaagccctgattctacgacgtagactgcgtgaagttttgctttccaggcctgtgcctgttcgacggctacttcaaatgccttttcactgacaatagatccgtcaatagcaacaagaattgtgttgtacatatactcccctcaaaaaggcttcctaactaatttggactttacctaaaaaattcttgcgcaaaaatggctcattggagccctcttcacaatggtggatttgatatcgcgggaatggcgcaaattaccccaggaacaatccattacacagaatgaagcccggttacccggcataatagaatgagaaattcctgatggaggaaatcctctggttgctgaatagaggaggttctcagccggcaccccatagacggaatggataaacgagatctcctgcatcatgtcaggctggacaaacataacattatcagtcccaatcagtatttcaacgccggcatcaatcatttcctggacaggggggtgagcccggccggatgttacccggaggagaaaatttgagcgacaacagagaactaccggtattccttcatcagcaatccttcggatctgggatttggtaacatgggtacaatgcactagaaaatcagggtgtgcttctaatgcagcatcaatatcatcaggatctttttcacccgcgtgaaacccgataatctttccctgccttttcatcaggtcagctatctccatggactgggtaacatcccttgcactgctaatccctgctccgtcggctatctcctctccaccttcacgtcccaggatgattggacgaatgtgcatctgggatgccgcctcttgtaatgccagaactcctggttttcccccttcacgaaaatcagcaaagcccgctgttccggaatggatcatctcagttatggaatctctcattgctgatataaggcggggcactgaggtttttgcaagtatctgatgcttgagtccatggggaggcgtgacaagttcatcaagtgtcccggcacagggcagatccatcgcaaccgtatcagcaagatgggtatgagcattgaaaaatgcaggacagatccattggtccgggacagatgattcatcctctacggcggtgatgatgccgtcctgaacaacgatggtaacgtcccgcgcctcaagggtttcaccagtcagagctgtccctgataccgaatactcttttatcatgatatattgccggccttgtcttttatataattcatcggtcagatatagattatggcaaaaaaagcaggtggacgattaatctcatctgctggtctcgtcaattactatgacagtgaagaccggcgggcagtccacatcagcccctatgtagttttggctgcggcggttatatgtggtgttgcaatcttcgtcctgaatatgatttcattctgatcttttacactttttttaacgctttcctgatgacgtcttctccttctctgaagtagatgtcattgtgtccggtccatgcaggtatgccacggaaatgaacggcaggtaccccgttattgctctcacccatgatgagatttgcaaatccggcgatctcgtcaaccaccgcttcttcagttatctccagagtatgcccgaagagatcactatctccgcggaaatctctgatggctgacatcccactccagccaatagcatgaccggtctgtccacgccgaaatgatctgccacaggtgtcagttacgatgatcccacagcttttgctggtgaggtcttttatctccgttctgatctcctcagcttccttcatgggatctgcaggaagggtgataacaaggccgtcctcaacattgcttgcgtccactcctgacctgactcctacatgaccgcaggatacttcagtgagggtgaatggtgtttctatgagaacgtcacaggcctgatctaggacgacttggataaagcggggatcttcacctgtcttttctgcaatccgtgttgcccggtcaccaggtatgacatcttttaaattccgggtgtatccctttgccttcgagattattgtacttgcgatacagatgatgtctccatcttccaaagcgcatttttcaattatcaggcggggaaggtcatctcctttttgaatcaggggaagacccctgatacctgttacggttactgaagtgtacagaataatccctctcctttcaggtgaaatgtgaaagaatatacgagtattgatcggagctttaggaatatatttttaaagttgatatacagacatgtataggtgccgagatagtctagtccgggaaggcggtggtcttgaaaaccactggtggtaacacctcgggagttcaaatctccctttcggcgtaaaaattttttttcagatttttgtttcattagttctcatatcttcattttgtctcgtgttaaatatgcggatcaccagtatatggaccgccttttttctgcaggagatattcagaagatagagcattaaaaggtgatctttatgctgaacaagagtatccggactatatactctgtagttcaagatgctggaatgatgcaatttttctgcatagtgaagcagaatgaagcaatgtgaagcagtgtgcggaaaagatccgctctgatatattattccgatttaagatctatcgataatttcataatttttgttttttaatgcggaaaaccggccgtcacacgtacatattaatccggtggctaatgatgattcaaatttttttgtgagtacacgagttgcttcactaaagatcttagaataatatatatgtgtacatatattcaatttagtgagttttcgcggtttttgactgtgaagcaactgcttcacacatgcagaaaagatatccttttttccgccatgcttcactctggtgaaggagggaagcagtgaagtgaaaacactatgtgggagagttgaaagataatggaatgggtgtttttactttcgatcagcaggtgatcctggagaaccggaagagaaaatcataacggggtcatgtaatataagtagtaatggttctggtgggcattgtataaacaggaaagatgaggggggttcacatacgggacagatattgaaatattatgaatatcagtctgctggataaagataacattcgatttgctattggagaggaacatgaagaaaaccgcaaattcattacagagagagcagacgcaacgaaaccaaacgagagtattaccagttcaggagagccgttttcaggtagggagatggaacggttgccaggaactacctgaatctgatggaataatagaactaaaccggcttgtagttatgtggctacataatactgaagaccaggcgaaatggaaaatcaggcgtatatgaaagaatcgcgggaaaactgaattggtctctcacctttcaagaaataagaaattctgaaatatcccgggaaggctatatcaaaaaaaaatttacgtactctcttcaatctctgaagtgaggtatgcatacaataacactgcaacaaccgctccgataaccggaccgatcacatagataggaaaatatatccaaagattcgaacccccaagcaccagatctgcaaggtatggcccgaaggttcgtgcaggattcagtgaagctcctgcaatattccctgtggcggttattatccctccgacggttagaccaataattaacccggcaaaccctggcggagcacgattatctacagcaacacccataatcacgagcatcagcagaaatgttccaatagcctccgccaggatagcctgtccatacgatattcctgggaacggtgcagtcgcccctaatcctccaatcagaactgcatccatgccgacggtcgctgcaaaaagtagacttccgagaactgcacccagacactgtgcaatcacatacggaataatctcttctgctggaaaccgtttcgtaactccgagggcaatggtcaccgccggattgatatgacatccggatactctcccaagagcatagatacacccggcaatggcaatggcaaagctcataccgatagcaaaccagtccccaaggccgccaagtacaccgattccaatattaaactcagtagaagggtttgtaccatgtgcaatcatcagggtgatagccgctgcaccagcaccaaagtataccagaatcccggttcccactccttctgcaacacatcgttgtaacaatgacatgattactccttcttatatgccgcaacacattccggacagaggattctgggcaatcgttttccgctcttcttaaccgggaagggataccccccttcccagagatcaatatcttcccgaatactatggtccatgcatagccccataccgcaggcaatacaaatcccaactgcatcggtattttttccttcttttgcacacacgtaacacttcatttttaacctctggcgtgactacacggcttctttccactggcaataaccatgacggaaatccatcagtgcagctgaagcacaatccttgcaaatccgtgccggagctgcaaccgtttctttatgaagagcaataatattcgtcatcagggtagcagtcaccggctcactagtcaggagacagggataatcggcaagcctcatcatggcagacatgcgaacggtcatggcacatgccggataagcgtatctctgtgggttcataaggacatcatttttatgaattggcgatagatcaaccgtaaatccacctactttcggggaggggattccttcgccgctactctgcatccgacgtgctttgtccaggtatttccatccccgataaatcatgtccataaaatcacagttgtggagctctactgcagcactccgggtaggataaagctgaacataattatggtatcttttcgtgagaagatccacgatcataatagcgttgaacccatcaagttccagaatatattctgccgcacaagcagaagcacccgttgcaagaccaagaaggtcatattcatttttaaccttcccttctgcttttttcagggtagactccattaccgccgttgtggcatctatggcagccatgacaacatcgtccttgcacatattgaacgtggattgcgagatatgatgggcgatatcaccgacacaatacgccggaatggtgacgatgttcccataatgaacaccctcctccatggcggccttcaccactggtgccatctttgtgcgatatgactccatgtatttccggtgatcaaaggatttctgaccaacagtatccataagttcagcctgcgccttcaccgggtgttcataaatcgcctggagcatgtcgatttcttttttcaccgcttcagtaagcgatccacctttctctatttcatgagcaaacacatcaccgataccatacgatgtgttcatcccccatgactttgctgcgagaattgcctgtttatgatccgcaggaatggtgatcccgctaagaatccggttcacaacattacttgttgaaccaggtataagggcaaaatccacaacacatgtcggaccgtaaaaccctccatatctccgtgctgattcacgacctataagcgattcagatttcttaattgctccgacaaaggtctcaacacttttagcaaatttaggatcttccttgcagagaatttccagaatgaccggagtctgataatgttctacgaatggatcatcctcgggtctgatcgttttcgtaaggccttttagaatctcaaaatgtgcctttacagattcggtgtgtaattgaaataccgacggagactgatctgcagcgggtttcatcttctgcacggcgtcgagatatggttgtgcatcgtcaattacaaaattccccccgcgttttttctttaccgcctctacatcggcatgttgagccgccatggcctctttgatcattttcttgtggagttcagacatcagtaacacgtcctggtaattgagccagcctccggtaatccatcagctgtatgttttagccatcaatggctgattatataaaagtgcgcatcatgaagacaggagatcgatcagaaaaaactgaactgatttgccttctctatctgccatacctgcagatctccacggtttggaaagacctgcgataaggagaaggccggaaccatccagcttgaaactctgtctgcagcgataaaaggtgtatatcctgaaatgggggagagatgcatgcaggcaatcagatcaatctgatcttttttgaatgatgtatctgtatatcggttttttcccgttcaggatgcaagggaactattatccttattttgataggataccccaccataaatttctgaaatcacactgtttcctatatatatgtgtatgttcaaataattttgaaacatttgtgagagagtcacgacaacaaatatcgcctgtatcggagccggcagggttacccgaatcctccttgaaggccttgccagaaagaattgtcttcctgaacgaatcatggtgactgataccaatccagatgtcctgaaaaatcttgcagaaaaattcccttcaattgaaccaacaaaccaggttgatgaatcgatgagcaacgctgattttctctttatcagccttcatccaccggtggttggagaaatgctccataacattgttcccttccttggagaaaagactaccatcgtatctttggctccgaaaataaaaatagcaaccatcaaccagctcaccggagcatcacgttctgtcattcgcatgatcccaaatgctgcctcatatgtgaatgaaggatacaatccggtggtatttggatcgtcttgtccggaaaatatacggaaaaaattcactgaactcatggtcgctctcggacagatgcctgaggttcctgaagagatgttggaagcatatacagtcataacggccatgggtccgacgtacctctggttccagctggctgaactcatccaccttgcacagacatttggtcttactcagaaagatgctactgatgcggtccttcccatggctgagggagctgcgaagatcatgaagaaatcagacctgactccagaggcggtcatggatcttgttccggtaaaacctcttgctgataaagaagaggctatcagggagatgtataatggatcccttaccgggttgtatgaaaaacttacgtcataattttttttctccggtaattttatctggtattcgtccacaattaagaactttttcccaatctatgttaatttcatggtcctcatcctgttcactattgcaggtaccaggctgacattgcatctggataaaaagttgatgccaaagagtttatatgctcctttttattatccaatatatttatatttgtcaatatttcaataaatattgaatcatcctgagctatactcagcaatggtataaaaccagaaacgtaatggttaaaaaagaagatagagtagtaaaatgatcatatcaataaaaaattccagatccaggatccatatcgaagcaatatgcttttgcttgttatttcttcttttatgcggagcatgtagtgcagattcttcaaactcctctacaatctcttctgattcaccagcgattcatttcttttatagccctctctgttcctcctgtcataaggttataccctttattgaggaatatgagacaactcatccgtatgttcgtatccaataccacaatatcggcgacaatgaggatgacatcctcctgtttgagacattcaggaagatgcatcctgacaaatcattattcgtcccggttgtttttataggagaggaggccctcatcggtgagaaggcgatattttcagaatttgagcaaaaagtcggggagatcaagactcatggtgcatctgaatttaatgaaaataggacttcaggttcagaaaccatcacagtaaatcccgtgatcctcctcctggctgctctgggagaaggattcaatccctgtggtctcctggttcttgcccttctgctggtctcacttatggcatcggactccaggaagacgattctcctggtaggatctgcgtacatcctggcattttatctggtcagggtcttatctggatttgcaattttctcagctattcagattccgggagttgcacagatatttctcatcgttgccggaatcatcgcgatcattgccggactgttccagataaaagacggccttgttaaaaatccgaaagcactcttctccattccccagtcgaagaaaagttccatttcaaaatacctgaagattgcaagtgttcctgccggattcatcgttggtgccctgaccggtctatatggtatggcctgcacggtcgggatatatatctcaattctcggaatgatataccaggatttccaatcgggcttattttatcttcttgcatataatttcgttgtagttataccgcttattacaatacttctcctggtcatcttcgggctctctccggagagactgaattcatggagagatgaaaggaagagcctgcttcgaattatcataggagttatcatgcttattatggggataatcatcctgatggatgtatttctctaaattttcagccgataaatggtgaaacaggtatgcatatggaaaagattgaacgtggtatgtacagtctgattcttctcgtaaatttggtaattctcatgctcatcccggcatgctcgggagcgatatttcaaaaggacgggactgaaatcacgcgagatgaagttacgaaaatatttacacataattcaatttttcatgaaaattctcccatccagatacaattcttttatagttccggttgtggcagctgtaaagatgtacttcagttccttcaatcatatgaacggaaaaatccttctgtcctgatcgaattccggaatcttgtatatgatgaagagaaccgtcaattatttaccgaatataaaaaccagttcaattattcgaaaatatcgtatcctgcattatttatcggtgatatcggaataacaggaagcagtgacattattcatataactgattcggtggtaaaagggtatcagaatctatgaagggagagaatggtggttgggatagtgaaatctatccttttgccatggtagattatggaactgacatcattgttcgtatattgtcattctatcaatgattgctctggataactcctctccaaatgcctttttatcgctgagtttataccagagttgtatctggttctctgcatgaaatccggtatcatctatatatccaatcatcaccgaagacgaggtcgtcccgaacctggagacaatgtctgcattctccgggaggtcaacattcacatgtctgaaaatgatcttcccttcatcaatttcctgcatgaatgatttattcatggcctcttcagtacgttctccaagcacccggcagggataacattgatgggtttcatggaaatgatatacttctagtgcttttggagggaggataaataatgatgaactattatgttgaagagagagattttcaagggtaaatatctggttgcatccgcatccgcctgacaggatcataatggaggtaattacagcaagtagcagaagagggatgaggatatcttttctcggaccttgaataggcattgataaaaaaataagagactatcgccggaggaaggttcaccggagtttttccctcacaacagatgtcaaaagttcaatctcgtcaaatcgcggatcttccataccattctttacaataccacactcagtggcaatgacatgaatgtccggatcatacccatgctccttaagttttttcctcccgcagcagtcagaacatccatcaataataactattctctttgcatgggcgagaacatcacgtaatttttctggatcacttcgtgcagcaagagaacattcaattatacccggacatctccggtggagcgcatcacttacctttgtcgtaagtttgcccgtattggatattcctgagcaggtcaccaaagcagtgtcagaatccaggtgcataaaaaatgattaggagcagttaccgctgcagccacacccgccggaaggaaccttcttttcagaattagattcctggatttttccttctcctttccaggcggcagagacaatagactcaacctgttcttttgtaaaagatcggtcagaggaatttttctcgataccaagatcggttacaaccagatgctgatgaaccggaactcccgcttgctcagctatctttcgtgcacaatccatcccacatccgtcaatagcaacgacttcatgtacattccgtgcacgttcagccagagactctgatccagatgccagcagggccgtgcatacaaagctgccatatccttcgtcagatagctgaatagcagcctgatttgatatctgcccggtatttgcctgcccggagcagggaaaaatcaatcggttcttctcgttacttccacaggtacagggggcttgctctcccattatgcattctccttgatgatttcgataatctcattaacagtgggaacccgaccggcaacaacttcttcgccgtccaggaacagagacggagtcatcatgacacccctgcttacaatctcttccagtgcttcaactttcgttacttcagccagaacacctgatttttttaccgcttcagttacattatcatacatacgtttgcatttcgtacagccggttcctaacacttcgagtttcatatttcacctttatttgaaacagttatgttctctatgaatatcatcttttgtttagagcgaggcacaccctgtcccggcatgatcctttgtaaatgcaccgaatgcgtgtttctcccgtgaatggggtagggctttctttgccaggtattcaagatgggaaaccatcgcagcaagatcatcagccgggaacccgatgatcgcttccccagaccccatatccgttgcatcccggcagccatagcatccaagtccataattcaaccggttttcaaggaacggaataatgcaggagtcaacacaggtagcctgcaggatagcggtagaaccctggacccgttttcccccgtgggcatggagataggaaagggcaatccacatgagtctctcaggttcatcttcgatgatgataatatcaggcacctcatcagcagaatccagagggaagattttaagctgcctgacagaatccaggggcagaatagtcatcccttcaaacatatgctgggcaaccttctcatctgaaacaattccaaagccaaccaggcctttaccggtccggagcggttcaggaagcggtttgaacccgaacgcacgggcagcagccggacaggtaatattttcctcggtgatgatacttttttctccataccgagcccgcattaatgcctggcaaaaccgcattggtgtctgatctccggcaaatgggggtgcaccgggagcctgaacaatttttactccaatcggtgatccctttagcgcaaggatcaagctgagggtcaacgcttcagttcgtattttttcaggggttgttgtgtgtgtcatagtatcacaaaaaatgttgagaggaattcttgcagatctcatgagcgtaaactggtgcattcgaagaatggggatcaggctatgagatactgcaggtttcatacactcatgtatcagaatttattgtactccgcaacaatcgcgttcgcatacatctcctcagcccctttagagatgtaattgtataccttcaccttcttgagaagagtttctttgatctgctgctcagaagtaagtttcatctcttttacctcagcgattatctcatccagcatggtaataccggttgggataccgtttaccgggatcatccgaatcctccggagtgcatccgccggacaacagggtttatctgcagccattcaaatcagagcccactgtttccgaatacgaatccggcgagggttgagaatataacgaccagaacagcatacactccggttttcttagctcccataacccgggtgagaaccagaagacttggcagacttatcgatggtccggtcaggagaagagagagagccggtccttttgccatgttcccggaaaggtagccaagagttgtcccgatcaccggtacttcaagcagggtaggcatgtagagtattgctccgataactgcagccgtaaagtttgccaggagagaattgtcaccaatgtatggcttaaatgtctccggtgggataaagtaggaaagcaccccgagagcaaaggttccgataacgaggatgggaaagatctttttggtcagatcccagatttcgtatccccattcggttacctcatctctgctgaaatagtagatgagcaggaatgcaaccgccatggagaggaagtagacaattagaagccggataaagatatccagttgagatgttccgaccaacaggattgcaatcagaaagataaaaaatgccgggataatccatttgggtcgttcttctccacctgaagaaagacgggggttcttttttgcatttgcacggatttcattatcatgctctttgaaaattattgccatgataaggccgatgacaattgacagaagaatggcagagacagcacgggcaattccaatatcaagaccaaggactttcgccgaatatactattgcaaggatattgattgccggaccggcatagaggaatgtgattgccggacctatgccacttccttttttaagaattccggcaaacattggcagtatggtacaactacagactgctagaacggttccggataccgatgcaatgccataactcaccgatttctttgcatcagggctgaagtatttcaggatagcatcctttttgacaaatgcagctatgccaccggcaataaaaaaagccgggataaggcacgtgacaacatgctcggagagatatgcaacgagggttgtccatcccagaagtaatgctccggtaattatttctatcattggtatcactgattctcaattatcttttgatcatcttgttctttttgaagaacgcagcagtaggggcaacatccaccacgcacggacattcttcgcatgataagcatcatcaggagcatgataattgcacagacaaccactatcccaataatgtaataaatgggaaatccaaagaatggcattataaatggcatgatttgttcatctcaaatgatctctgatatttcatcagaatgtttcaacatttattgaagtggatctttgaactatataacaatagctattttaaataattttggaatatctgcgcgtaaataagaaattcttttcaaaataataacaatatttaatgatatctgtggtgccggagccctcggataagtcatcatgagttcatcatttgcagaagatgcactcctcttatctctcaaacaccggcaattttgctcatgctgaccccatttatccttgcggcccttgtccagatggcacaggaataacatatcgtaactgcgtcaacaaccgccatcctccttgctggaaccagtattccagcactgatgaaccctctgacgttgttttcattcatcatagccggagccggagtgatatgttttgtcactgatccctagtttctgactgcttcatgggaaaccggcgatgaagtaaaaaagatttttacgtactatacacttccccagattcttattgggattactacatgtattctggcggttatgaaacagatactcttcccgatatcactttaataattcgttgacaaaaataccaggaatggcaaaaaatgattattctttcgcttctttcttctctttagatgaacagcaggaaccttcttttggaacaatcttcggaccacagcaacaacaagatgaatcttttttaccgaatatgcgttccatgaaacttttcttctcagccatgtatagtaatgtatcgtaagcacctaaaattttatggaatctccttgattcatggctatccagattgtcagatccaatcctcgatatctcatctcaaaattatttctaaggttcttagatatccataattatttagaatacgatcagaatacacatttgttttaattcacaccttgagaactttgatagttcaaacaaatatgaaatagatacttataaataacgaacaaatcaatagatattttggtttttaaacttctgaaggaattatcgtggctctctgtcaatggtgtatgggctggggtgctgatccacctgttcttttctgaattgtaacaatccggagatttccggttaggtaatgcattgcagatctacgaaatcgtatctttagatatcatgtcattgtatgtaacgtctttagggcctctattttgtgcccatacaagcgatagctcactgaatagagaactgaatagtctattaactggtggagatgaccatgactgccatcaatgatctcttcaccgcgggtcagttttttctcattataactgttgaactggttattttatttatcgggatcagtttcctggtcggtctgattcgggaatacgtaccggaggaaaatatacgaaatgttctgacaagtaagcaccgaggagtgggaaatattttcggggcattttttggggcacttacccctttctgttcctgttcaaccatccctatcctggttggactgcttgatgtcggggttccattcggaattacatattcattccttattgcgtcacctctcttaaatccggtcattttttttcttattctggcactctttggcgttgtgccaacactgatctataccattatcacattttctatcgccgttatctcgggtatcctcctcgaacgtgccggatatggcaggtatgtgaaagcagtaacattggagaagggatgttgctgtaaaggtgaatattccgaaaattcagtgcataaaacccagttttcccgggcactcacctttgtcttcaccctattcaggcagattgtcccatatctgattcttggtgctgcaataggagcctttatttatggttttattccagaggaactcattgtagccgccgcaggacctgacaacccacttgcaatcccggtcgcagcggtcatcggggtaccgatgtatatccgggctgaaacgatcatccccataagtgccgtccttcttgaaaagggtatgggaatcggtgcggtgatggcacttattattggcggtgccggggcaagtatcccggaagttacgcttcttgcctctatctttgaaaaaagactggttgcagcattcgtggtcacggtcctcggggttgcagtccttgccggagtgttgttccaggtactctcgaatatgggaattctcatctgaagagagaaaaaacagaatagttctggttttcaaaaattttataaattttcatgaaagaagggttaatatacgcactcaactttaccttcaaggaccttccctttacaacaggtttcagtttttggactataacacgtatcaccacaagcagtgaacccttttccatcatacacttcaccaagacaacaagactgatttttcgtattataacacgtgtcaccgcagatctgccatccgaacccatcatagatctggttattacagcaactctgactggtcaaatcataacagactcccccgcatacaccccagagtagtccgtcttttggttcaccaaggcaacatgattgattagtgggagtataaaacgaattaccacaagtcggaagacaccggcttccattcaccacgattgtgttacaacagacctggctttccatattgtagcaggtatccccgcatactccaaaatgaagaccgtcgtatacctgcccctgacagcacgattgtttactgggatcataacaagtgtcaccacagggcacacatactggtttagcgccaaatgctgatatcgataacaccaatacacagatgaaaatcaaaccggcgatggtaagagagaaccgctgcaaatcctatgataccgtttcaggatctgaataagtttcttctagagggataatctgaaaattaaaagagtttgagatttctgaacaatgtaaaaaaattggataaaaatccttgactttcatgcatattctgctgaagttctaatatttctcccaggtgattgctgatatcctgagtcccttcaagggtaagatttcctatcatcatggaaggtacagacaggtgggttcggtgatatgttgttttatactgttcgaatatcgtccgattttccgggctgttatagagatcataatccaatagtttcatctccgggtgttctggtatgaactcatccagaaaatcccatgccatatggcaaccgccacaatgagtattccagaagaagataactgttcccggagggagatcacctccaatcagggatgaatctgaccgtatgagatcagataataattctgaatcaatttcacttccatttatcgaaaatatagctgcagataccggtgcaatacaaaaggcaagaacaagtcccagaaagacaagggaaaaaaattggtttagagatgatgaatgaaccatcgtacccttaattcatattacctgaaagtctcttttctatcaggtctttcagatatgcttcatattcatcaggatttccaagtttgtaccagactctggtatcttcttcggccttaaacccgtcaggagtgtataccccaatcatgagagatgatccggatgcaccatatctatttgttatctccttatcttttggatcatcgacggttacatggccaaatactaattttccggattcaagttcatctgcaaagtttttattcaccgtctgttctgcaagttctccaagacggatacaactgtaacactggtgttttaagtgaaaatgatagacttccactttttcaactgctgaagaaccaccatctgttgtttctgatgctgaacaggtaaggatggctgtacagagaaataaaacagcagtaataataatgataaaggcaaattttctagatctggcgtttaaattactcatgcgttaactccttcaatacgtggaaattgaaaaatttcagatgagatatctgatgaggaagacagatgtgaagacatccaatattctaagaacagggaatattttctgtgaactctcatctgactaagtttcaatatattttgaatcatatatataatttccggaaaaagagagattttttcctcataattgcaataattacagaagatatgcctgtactgtatagtatgccccaataataatgaagagtacagcaacagctcgacggaatatcttttctgctgtctgaaccttgttcatcattgctccacatctgccaacaccggtggagagaagagctgcaaaaatgataacaggaagaccggttgccagaccaaaaacgagcgggacacctatcggatcctgaacgcttaatgcaagcgggaccagcataccaaagaagaggactgcactaaacggacagaaactgagtgcaaacaaaattcccaggagaaaacttccgaaaaagcctttgtctaaaaatttttttgataatttttctttcagctctgaaaggccttcatgctcaaatttcatgctgagaggaattacttcgagcatgagaataccacagatcaagagtatcggtcctaacaggagatcaccgtactcttggaggaagagcgaaatggactgtactttcaggccaccaaggacaataagtgctgcaatggcaacatacacaagaacacggccgattgtgtagagagagcctacgaataaggtatactttccggatgagagatttcgggagatataggcgatagcagtgatattcgtagccagcggacagggactaatcgccatcataagcccaatgaaaaaggcagctacaagaggaatatcgctacttcccatcgcttccatgaaagacatcagatcgctcaagattgacctccctttaaaattggatccagtattccagtcaggtaatcagaatattcttcttcatttccaagcctgtaccagagaccaaccagatcctgtttggtaaatgagtctttcgtgtataccccaatcatgagtgaagaagagaccacttcatatttttgtgcaagatagcggtttgccggatcctctgcattgatatgaccaaatactagttttcctgatgcgagttcatccgggtagttcttttttactactttctctgctaagtctccgagaagtacacaggaataacactgctgatttccatggaaatggtagagttcaaccttggtaatatccggcaacgcagcatcattcggtacttcatttttcaccgacgattcattatccagactggttccggtacatcctgcgaagagagtgagaaacagagcacacaaaataagtgctccggttatcttaagatgattttgtttcatttagaaagctccacataggtgataatcacaaatgtgacctaaactctctatagattttcactcaaggtattacaaactttcttgaaccatatggagttcgaaaaaacataggttgtgctggtgtatgctatttcgcgagaaatcaggatatttccgtttcattttatgatctgtacaacagttctttgaacaatatactgtttaccgagtataagacgaaatttaacgataatatctatatacattatccagcggttttcattggggataatgtactgtaggttcttttgacattgcgtcatatacagaaatattcacgaaatggtatcaggaaaaaaggaatacagaagcggtatccggatttttcccggtataatgacactcttttcttaaaatgagaattataagccgaccattttggttatctgtactcatcactctgcccgtcacagatagccgaggggtatatcaggaactggtacggagatcggtataccgtatatagcgcaggaacagatgtaaccagcgtccatcctcttgccgttaaagtaatgaaagaaattggtatagaaatatctcatcatcgatcaaaaccactctttgaatttcttgatacagatgaggctgttgcataacttcaaacagttagtacaatgaggaaaaaccagatttttttcgaggatttaagctccaatcggatggaaattgtcctattgcagaaatgacattttggttatgcaacagtctctgatattgatattattataacggtctgcaatggggcaaaggcagtctgtccggttttcccggagcgaggcgaaccatccatcagggatttactaatacattaaaagtcacgagttcggatgaagtgaaattggcaatattccggactttccggtatgaaattaccccgttgatatatgacattgtaaatcctggcggagcactgacttggttatttcatatctcaaactttattgaaattgcccaccaattctatactgattagtttgaagatagggatagtcagtgacgggcagtacggagagcgggcatttgagcagatacgaagacgatttcctactgaatggatcctgctgccttacccttcttcaccagtagtcgatgaaatagaacttaccattcctccctgtgatttgtacatttcctatctccggcatccggatatcgccatggaacttatccggaccggcattccggccctgcttgggataaatctcggaccaggtttcattgctcaggcacatgaattcaatccggctgttataggtccggaaacgatgtgttcagtactgcccaatacgaagttctgtcaggtaaatgaatatgcgaaggtgtttggcagaccggtcttctacctggtgatggatggagatcgcattgtttggtgcaaaacaatccggggatctccatgtggatcaactgacgctgctgcatctgaaatttctggtcagattctggaccaggaggcattaagcaggtttgctctttctatatgtcataattgtcgtgctccccggtttggtaagacctgtgataaagagaaggccggaattattcatctagaagaattgatgcgggctttgaaaggggtgaatccaaaaaaatgggaagaactgattcaggtgctggaaaagataggatgctcttttcctaatgaatagccatgtccggaaagagcaaaagacttccccattgcagcaggtttctttttttagtaaaaacttttttgaactattcatacccctaaaaaagtttacctcggattaagacctcaactggaaccatcctctggtccgaagacacatatttacaagggtaagcattgtcgggacttctataagcactccgaccaccgttgcaagggctgctcctgaagaaagaccaaaaaggatggttgccgtagcaatagcaacctcaaaatggttggatgccccaatcatggcagtaggggcggcatcttcatacgagaatttccatgcttttgaaaggatatatcctaaagaaaagatgagtattgtctgaataaaaagtggaattgcaatccagagaatcgtgagaggatcattcaggatgacctctcccttaaaactgaagagcaagatcaatgtgactaacagagcgataatagtcaccggggtgagaagatgcatgaattttgtcttaaaccattcttctcctttatatttgatgagaagaattcgggatagatatccacagataaggggaagagcaacataaattgcgattgataatgccaaagcctcccatggcaccgggagctgtccaacaccgagaaggaatcctccaagagggccgtataggacgagcatcgaaagggagtttattgcgaccatgaccaaagtatgaccgtcatttcctctcgccagatatccccagaccagaaccattgccgtacagggggcgatgccaagcagaatacacccagcaaggtaactcctccagaggggaatttccagcatctttaccccattctccaggactacggttccatctccgtatgtggccccaacaggaagatccactccaaatggcatcttcacaagatccaatgcatctggaccgataaactgaagaaacagatacccaagaaaaaatgaggcaatgatatacatggagaatggtttaattgcccagttcacaaagagggtcagagttacaggtttgatattcctcccagctttgagtacttcggcaaagtcgatctttaccataatgggatacatcataaaaaacagacagagggcaatagggatagatatgacaggagcttctccgatataaatggaaaggccatcaaggtactgtgctccatgtggtgcaaaccggcccaggagaattccaagggcgatacagatcaaaacccagatggtgagatacttttcaaaaaagccaagaccttttgatttgtgtgggggattcgggaatgcctgttctgtgttactcatgatacacaattgtgattcaaaattatttgaattttatgagaggtcaaatcacaaaacattctatggtatctctgatatgttcggtaataggatgaaaatcaacgaaaaacaggcatactttttagagaaaaattactgtataacaaaattttcccttaaggtctttttttcttctcttctgaacagagagacaatgcttttactccgagatcagtcagttcataaatgatatagttaccttgggatgttccttcaatcaaccccatcgaacttaattttttcaaatgatatgaaagccgggtatctgatattttcagtaactccctgataatacagacacaaagaggctgaattgaaagcatggagaggatatttatccgaaatgggtctgataatgctttaaagagagagacgttttgcataatcgcattcctgggcatgatttggtttgataatccttccagaccacctattgtcatcagaggttccagaacttcaggaggtattttgggtggtattgcagggtctgcacaattcgtgctgcaagcggcctttttcatggtacatcttatctccctgatgagaagttcaatatttcgatggtcttatgatatctatagagactattgagaaaatcctcatatggctataatgctcacgtaacatactcatattatgcataaaccgactgttttgtttatctgtacccataactccgccagatcacaaatggccgaaggatatctcaaaaaccgatatggagatcggtatactacatatagcgcagggactgaagttacccatgtccatcctcttgccatagaggtcatggatgagattggcattgatatatcacatcatcgttcaaaaccgctcctggaatttttcgatactgatattgatttcgttgttacggtctgcgatggggcaaaatcagtctgtccggtttttcccggagcaaagaagacaatccatcagggctttattgatccatcttcagtgataggatctgatgaagagaaattatcggcattccgggctgtacgggatgaaattattagatggattgacgagaatgtcaaacctggcggagttcttgttttataaattgaatgacagaaatttcaattttgaaggagtgagtcggttttgaaaattagtaattcttaaaaatgagagatgttacttctgttttaatgaaatttctgtcattttatgagatgagctgaataggatacaaagaggcccccttcgaatcaaatagaaaccgtcaatattttataagattttactgcaacagcctatccatcctatttcataccacaacaagaccctgcatctcctccacaactgcactcaccactatccatatctctcccccgaagagcagcactaatcattgcccaggcacatcccacaccactctcaacctcaattgcctgaaccggacaattcaatgcacatgcaccacactccatgcaccggacttgatatacaagattaacatgagattttccagcagaaaacacaccatgagggcaaacctcggtgcatcgtttacagttgatgcatctattcttataaaatttcaaagagttgtcaagatatgaatgaaacatcagatcactcctgctaatcgaaaaatactaagaactattccaatgaccgacccgatacctgtcatgacagccattatgggaacatatctgaatatctccttttttaccccagttcgtgaagtatatggcgtggacccggtaaaattcagtcccaggtatgcaacaactgcaggaataatcaaaagagggacaattgctcctgcagccagtgcccattccggaagatctgctgattgtgcatacatcgccgagaatggaactgcacatactcctcccagaataaatcccttcattgagaagtcctgagtcgggagatagggtaggagtattggaaagaggacagtaccggttatgacagcagcgattgcagcaactccggccgctggtcctgctaacaaccaaagaatgatagagataatgatggtcggaatggcaacatgtaccagttctattggtattaatacaagccgatcctgtataggaaaggataccttacgcatttcagaggtagccttcccggttctcatatattcaggaagatcagcagcccgtaccggaccatattcaaccgtaaacccggatctctgtttaaccatatgcgcagatatcccgggcgcacccaattgtgggacgataatattccgatgggaaacaatgtgagacagccctgttgattcaattctttttaccagttcatcagtaccaaaggtcccttttcctgctgcacaccagacattaatcccttttgtgtccagtacaaggatgtatgcatcaaatcccttcaggtttaatcgaagagtatcaaagctgatagtgtaatttgcagatgcaaagaccggtgaatcagcatcaggattgcccaatcgataaaggcctggtcgaactacatgacctgagcgtttatatccccatctggccaggatatgatcaattctgtttgcaatagtaatatttgagtctgtttgaggtattgaataagaacaggctgtatccggttctgaacatgaacaacagcatgatgtttccatgttatgctccggtgtcattcatgagtggagagaggacatcttttaccatcccgctcaggttttctgccttcatcagtgccatacaacagatagtaccttctttctcccaactgatgagagccagtttgtctccgggtttaatatcggcacgttccctgatatcttttggtaagaccatctgaccccgttcatcaatcgtgagaatggattcaaccttgcatgtcgtcttctggtcacaactacagaaattgcggtcagtatgcttatcatcttccggtttttctttggccatactcttcatatccgttgtatttcatcatatttaatatattcagaataatcagattaatctgataaaaaatacgaatcagaaataattggtaatcaataacagccctgtattatcaaaacactatgcaagctaccatctgtcctgcctcatagatcgattgaatagcgtccggatatgatgatgtgattaggccgtattttttacttttaaaagcaaattgaagatctttttcagtaaaaatatgcgccctttcctcatggatttatttttcgattttaacccttatacggccaataaatgaacttaagatctcctgttttaagcttaaggacatgccccattaaaaaaagggttttttgaaacatttagtataatacctacaataccgaatacatcacataagagtaattatatgaactttaacgatggaatggttgtaataacggggatactctgtttccttgcaggcatcctgatggttcccatgatcgatgcatatgcactctcccattttgggttcaacctccccattgctctgattggagtggtagatttacttcttgtcatcgctatcatttacgttcacacccgcatcgtgctctataatcagaaaagaaaaataaaaagtatatcagaagggttcacaacaatatttaaaaatgagggttctatcaggaaagagaaggaataatcatccgatccagtgacgttatggacatctgatctcccccggttatatcaactcccatttctgatcgtttcagtactattcctgccaaatcttcagaaccacagagcagatgttgttcaggatgggtcccccgctgtattgagcagtttatctcgatatgatctccggcagacacaaccatggtaagtcgtttactccccggatgtcctttggggaggactaccaggggagcatgatacttccggatgagttctaaaagtatcatcgcctgtccaatctcccctccttcaggtgcagaaaccacaaccagatccccctcttccagatagtgacaatattcatcgccgtacatttcgataaaaagatgaaagggggagagaacccttcctatcaatagaaatgacagtggggcctggatacagagatacccttcctgtaaaagaacattcatgtcggaacgcagttatcagaaccacaggtaggacatctgatattcttaccaagggaactaaaactgccgccacagtctttacacttgtaattctttgctttcaatccttcatcaaattcgatatcaacaggtccgcctacggtgcacatttgtgaatcacctgaatatcatatcttgacatatgcagcaataaattatccgcttctatcagataatgtaagattgacatgagctgacgggacgttcattgcctggttgcttatgctctcatggcctgtacagttttcatgattgtctccggtcttgaaattactgaaccgggtatcatcaccccgttgacctttggtctttatgataaattcatatcaatccggaatcattcatttctgtgggggccattttgtatcctgtgtaccctccatatctggctgaccaggaagcaattaattcaaaaaaggagtgaacggaaatctacggacaattagagttccacccgggttattaccccatgaaccttatgggaaggtagccggtaatactggacaaatgatggacaaagtctcttaatggcactgaatattttccagataatatttcgggtgacaatctcttccatcccataaaagattgtcttctcttctattccggcatcacgaatgattcgcatcagatcaataatctgcatgtatccgtaactgatggagagatgggaaagaccaggttctattgatttatcgaaatgccatgaaaatccatatggctcatccttgatatccaaagagataatgacattttcctcatagattatctcattattaaacatcgtccgggagatgtatgccggaacctggtctaaagagcgggcaaagaacagggctgtcccccggagatggcgggcggttttatatgcacgggtgtatttcttgataaactgatcatgacccatcggtttcatggaccggtacaacgcccgctgtccggaggtgtatatgataactatggtgaatggaattgctgcgataacgagtgataaataaccaccatgagtgatcttggataccgttgacaggaagtaggtgatatctaccaaagtcacaatgagtgctattcccatatagaggtatttacggcgttgcaggaagatggcaatcataaatgaaccggtgatggacatagttccggtcacggcaagaccataggcacttgccagtcgttctgagtattggaatatgagaagaacgcagatgaccgcaatacaaagaagccagtttacggtgttgatgtaaatctgggtcctgagttcatcagatgtataatcaaccgggagcatgggaagaagatgagtggtaattgcctggtaaataatagagaaaataccacttatgaccgcctgtgaagcgataatggttgcaataatcatgagaagcaggaatggaatgtatagtatttgagataatgaaaatatcatctcaaacaaggggtttatgacatcggtattcctgagtaaatatgctgcctgacccagatatgagaaaaataccgcaataaaaacaaatccccaggcatattgaatgggttcacggccaagatggcccatatcggcaaataatgcctcagccccggttgcacacaggacaatcatggataatgagaaaaagcccagaagtccattatggataaaaaattctactgcatatatgggattgatggccaaaagtatctccgggctgaaagcgactgaaatcgcaccagatatgaataatgttaaaaaccagatgaccataaccggtccgaaggtccgggaaaccccttcagttcctctcttctggaataaaaataaacccagggcaataaggattgcaaggaaaatcagccagtcctgggcaatgagttcaaatccgggaatctgccggacgccctcaaccgcggagagtatcgatatcgccggagtgataacgcattcaccgatcatcaaagagataccaagggtagcaagaagggtaaatactgccactcccttcggtttctttaaaagcggaataagaatcccttttaggacgagagtgcctccttcaccggtttcagaaagacgcatggcaaggaaggtatactgaacggtgaccatgatgagaagcgtccagaagatcagggatactgcacccatgatattttccggagtgggcggaaggaagaggaataaaactgcaagagtgtaaatgggactggtcccgatatcaccaaataccagtcctgcagcttttatgatagacgtttttgatgggtgttccattgtcttacttatagttcttctactcattcagttaataattcccgatgatcggaatatgggaccgggagaaaaaaaaaaagagtatacaatgaaaataaaactatcagcgacagcggatgtaccatccggttttcgtctcgtcaagcactttttcactggtttgtttcgtgcacaggctgacaataatcattgcaatgcatgagataattaccgcataaaaactgaaatgaagcggaagtttagccacgtactgataatatgctccgaatattcccgcagatacaagacctgctgccatgctgatgattgcgcccatccgggtagcccggcgccagtatagaccggcaagaagcggaacggcaaaggttgagagcatcacaccaattcccatccagataaggaacgcgagcatctccggggggtttaatgcgattatcatggtaaccagggctgaaagaatgacgactatcttactcatgaggagaacctgcgtatctggggcatttggtctgatgatcttcttataaatatcccatgagaacatggcaccgatagtcagcatgagccggtcagtagttgacatgaccgcggcaagtacaatgacggcaaagatagaccacagagcaatatgggggatcgcattttgtattccatatagaattacaaaatcctgtgcatttggaacatccgggagagtgaatactccttcctgtacaaggacgatgcctgcaaatccggcaaattttaataaaaacatgacgaccccatagataaggaatccaagaagtggagcccaggtaaaaagccgggcatctttcacggcaaggatattattaatgacatggggtgcacaggcaagaccgatgatcaataaaactccgaaagagaccaggtatgcaggagtaaagaccatccctcccgccatccagggctgaaccagatcaggatttactgatgccatgaattcattgacatgagtaaacccaccggcatagaagataatgatcggtgccatgatgacaacgccaaggatgagaataaaagactggatcagtgcggcccaggcaacagcatacagaccgccgatggtcgtataaatcgttacaacaagggttgcaatgataagtgccagccaaagtggaatctcaaaaagccacataagaacgatagctattgcagtatactgtccgaccagatagatgagcgatacaattattcctgctactgctgacaacgttcgaagggcggtcggactttcataccggtgggccaggtaatcctgcacggtcatgtacccggtgttacgggtaatagcatgcagtttcactccaaagaagatgatacaaaaggctatcgagagtggaacaaatatctgttcccagatggtcggccatccgaatttaaatccaagcccggagactccaaggagagacattccggaacatacagttccgatcataagaagaacaaatacccagaatccaagagagcggcctgctacaagataatcttcagtattttttatcttccgggatgcccatcccccgatcccaatcattgccagacaatatattactacaattccaatggttgctccatcagccattatgcctcacctctgaaatacagaccccagagaatgagaagaatggtaaagaaaacaaaagctccgcctacaataacaatagtttctgttggtaacccaaacatatccatgcatctttgtgccatgctaacatataacaggctcgaatggtgtctgacccgattcctcggttaatctggattagacctagaaaatccgacaattccttaaattatggaagccgagtacataggatgagtctcttcgatcaaaaagcgcagacaaagttctttttattctgcatcggcatggtgctcctttgtatagttccggcatcagcagggcttgaaggacctgttgttgatgcattatcatactataaccaggcagttgatgccgcaggacagggatcctatgaagaggcaatgaacctgatagataaatcactacagatccagccagatttttatcttgcccagataacaaaggcaagtctgctctctcagaaaagtgaatattcagaggcagaagatctgttgaagcaggcagaacagtctcatccgaataatgcattcgtactggctgcgcatgcatcactctacattgaaaccgggcggtataaggaagccctgaccgcagctgaggctgcactggaaaaagaccctactctggtggaagcatgggtgctgaaaggaactgcacatggtggcctggctcaatatgaagaagaaataaatgcatcagagagagcccttcagattgaaccggcacatccccaggctttatccaatctgaagtttgcaacagagtcccttacgatccatcagaataaaaccggtcaagatggtgctgagaagactcctctgtcaatacccgttgttttggcgggcgtcctcttcgcttcggtgtttcgaaagaagatgtgagaacacttttttcagatgtctttttttgtttctccttttttctgtctgaagaggcagggatttgaagtaatctttccctggcacaatcacaatattctgatgagatatcaaggccaataaaatggcggtttgttcttgctgcaacagctgtcgttgtcccggccccgttaaagggatccagaatgatatcgccctgaaaactaaataatttcagacaccgttcaacaagctcttctggaaacatagccggatgattaaaatgtttcatcctccgttcaggtccgattgaccattttgctacaacccatgatttgaactcttcatcagagatatctgcatcctctgactttccactctttttcaatgtccctttacaaaaaatctcgataaattcccaggtatatttcagatacgggctgctgggacttttccaactcccccatgacgtatatttacagttataattattcttctcccagaggatctcacctttccagatcatcttctgattcatgaaaaatgatgaaatgagatgatgaaggggaatataatctgagaacagaggctggacatttacaatgaaccgtcccccgtatttcagtaccctgataccctgggcaaagacccggtagagtttatccaggtatgcctgccagtgagcactgtctcctgatgatgagtattcaagaccaaaattgtatggaggagaggtaataataagatcgatgcagttttcagggaggcgagagaggatctcttcactatcaccgcaaatgatctgatccaggtactcatccggaagaggatgtgtttggtgagagaatgaatttccttcagcatagaaaaaagatccccgctcagactccttctcttttcttccggtgactttccgctcatcagcatagcctgcatatacccgtttccgataccggattccataactcccgattgagactattttatttagaagtaaagaaaagggattttctaacccagccagatagtgatcattcagacctgtacgcgtgatgaattcgttgatagaatattcatattgggtgggatcaagtttccataactgtgcgataagtgtctgatccctgacatccagtgcgatctctttgcctgaatattttctattcaaagaatgaagaactgagagctctttttgtaaaagatcacgagatagtgggatttcaatgagaacggggttttgttttggggtgattgaatccttcttcataaaaatatgactaagatttctgttttataaccatttacgagtacctgataccgacctttgggtgatatctgatatgtttataactatccatcccagataatagaacagggggaccagattgaacatcaaagataatacagggcacagtgttcagtctgaacagactcttatttctcttctcttgaatatgcccggccctgcctgtatcatagatctgacaggaacaattattcttgcgaatcagaaatttaaggatattttaaagattcctttagaacaagaatcattctcttttaatatactcacttttgacagcccctttcgtgacttgagtcaggacattaccgaagtaggaaccgggacttataaatccacacataaaaatatactatttcactccgatgatgatctggttcattgctatcgaattgccataacatcatttcttgatgagaaacaggaaacgttgatcttcatatccggatgtgacatcaccgctgaatattatctgagtactgagcaaaatcgaatcaatacccttcatggccttatcagggaaataatcagttcacatcttttggatatgcatcctgaagagcagattcagcagataatgagtcgtgtgggtgcggtcatgaaggtgcaatattcatcgtacctggaaattgatcagatctcaccgcctcaatctatccaggaacggtttctctggtctcatcggtacgggtttctaatcggaactgatatggatgaactccgaaacgacccgcaatttttatctattatgtcagagctgaagtctcatcaaccgataattttcagaaaacagcaaacaaccggatttattcaaaagttgcttgaagaacgggagtcaggttcactggtaatggtcccccttatgagggattcgtatctcaccggaatactaattttttgggatgcagcagaagaacggcggtggatacaggttgaactgactactttgatggttcttgccgggattatcgaaacccggttttccagacgtcagatcgaaggaacactcgcgaaaagcgaacagaaattccaaagtctcatcgatcagattggagatatgtattttatgactgataaatcaggatatctcatcaaggtcagttcctcgatggtgaaaaaccttggatatcagtcagtagaaaatctgcaaggaacatctcttgaaaatgttgtccatcctcctgagttctggccgatttttctttctgatattatcagtagtgaaggagtgaaagactatgaaattcagctgattacccgggatcagaagattatttactcttcgatcagttgccgtcttatctatgatgacgatgggatgcttcaggggattgaaggggtcatacgggatatatccagacggaagcaatacggtgatctactgtcagatattgaatggaaacttgaacaggcccagagaattgcaaggatgggtgtctggtcatatgataatcatctggaacgattcagagtctcgcctgaagtcttctctctgcttggaatcccccctgaccggaatgacgtggtcattgatgattttatctcccgtacctatccgaatgatactgataaatttcttcattattttcctctcgctgtgaaacagggaattgaatttgattttgagttcagaattagtctggaggaggagaaatttaaatacctccggataaaagggaaaccattaattaagaaagggatcgttcagggttcttttggcatattacaggatacaactgaacggaaagacgtagagaatcacctgatgaaatatgctaccgagcttgagaagaagacgatagaactggatgagatgcggacccagctccttgatatgaaccgggatcttgattaccgggtacggaaaaggactgttcagatagaggatttgttaaaacagaaggatgagtttatccagataatcggtcatgatctgaagacaccactcacacctcttgttgcgattcttccatacatcaggaaaaaagtaactgatcccgaattgtgcgaactcctggataataccatagaggatgtttctaccatcagaaaactggtcactacaattcttgatctcgcacagatgaacagcctttatatgatctctgacatccagaagatacatatcagggaaatgatcgatcagatagtgagtgacaatgcctatcttattcatcagaaaagtctgaaaattacaaacaatattccggatgagtatcaggtattgatgtcaccgatgcattttgagaccattttaggaaatctcatcgggaatgcaattaaatactcatttattaatggcaatgttactattgatgcaacagatctgggagattccgtaatgctctctatcaaagatgaaggaattggaatcgaaccagaacatatctcaagggtatttgaggagttttaccgcgctgacaactcccgtcatgagcgtgggtcacatggccttggccttgcaattgccaagagggtagctgaaatatatcatgggattattaccgttgagagtgccggtgcaggaaaaggatccatgtttcatcttcacctcaagaaaaatccggatacatttcttaaaaaaagagaaggactgatacagactattatccaaaaacagggggaagaaaatggcagagcataaaggagatgtaatgattgtggatgacgatgcgcatgtcagaatagcggtaaagaccatcctttctgatgcaggatttcatatcatttctgcagatagtggagggcaatgtattgatctcttaaaaaaaggattttcaggagtcgtacttctcgatatcatgatgccggggatggatgggtgggataccatccgggcaattcttgataatagtcttgagcaggggatcgcaattgtaatgctcaccgcaaagaatgctcctgatgcaaaaatgattggtcttcaggagtatgttgttgattacataacaaagccttttgataatgaggatcttattgaaaaaaccacgttttttatgggttttgtacggaatcaaaccggcaatggaacaactacagaatgaaaatcatcataatcggttcatctacaggcggcccgtatatactggaatcaattttctctgattttccagttgtgaatgcagccattgttatcgtacagcatctccctccgacctttacccggactttagccaaccatatctcatcacttataaaaatgccggtttctgtcgcgagtgaaggagaggaactggcagcgccacatatctacattgctcctgccggatcccatcttctgataaaaaataatagaacctttgccctcaataatagtgagaaactacatggtgtccgcccagctgttgatttgaccatgctgtcaatgcagaaaaaaactgatgattctatcatgggcattgtactgaccggtatgggacgagatggtgctgatggtatatattttctgcatacattaggtgcgattaccattgcacaggacccggcaactgcacccattaaaagtatgccacaggcggcaatagagactggaggagttgattttattctgactccggaaaaaattaagcatgctatcattcagttttaataccacccagttcatctgtgaccacaaacaattcattaatacctgccaattaatatgatagaactatgaaatccagtagaaaagacatgtacctggaacaaatattcggctttttgatactatgtatctgtatgatatgtatgatatcattccctgtccttgctgatgaaggaaatagttcaaatcagacaaatcttacctcatggaacgacaccccgatgattgaagggttagaatatccagaggatggattaaagacggctgaaggtttagattatgggatctcagcccagggatatgctgatgttggtcgggtaagcaccggattttctggatcttccctggaggcacgtggtaataatcagtcttcatcggtggttatgtcgttctctgacaaatcatcggtaagtggatttatcaaaaactttatgaagtcttttcattatgagagtggaacagatctctaatctccttccatcgccgtcaattacttattcttttttctcattataattctggaaaagaaatggaaggagaacaggagagttcacatacaactttttcacgaaatccacatctgaaaaatcctaatttgtattttaaccgggaactctcgtggattcagtttaaccgtcatgttctggatgaagcaaaggatcattctcatcctcttctcgaacgggtgaaatttttatccatttttgcaaataacctggatgaattttttatgatccgggtatcaggtcttcatcagcagctacaggaaggagtaaccaaggcatctcctgatggtctctcacccggagaacaactggacgccatatatcatacacttgttcctctccttgaagaagctgtgaaaacatggaatgatgacataattcctgccttaaaagaagaaggcatcatcattcatacctatgaaaccttacatgaagaacaaaaatataatattcgtaattattttattaaagaaatctttccagtacttacacctcttgcctttgataagtcacatccctttccgttcatctctaatcttgcattaaatcttgccgtgatactcagaaaacgagggcataaagaggatttatttgcacggatcaagatcccaaataaattatttccccgccttatcccggtaccggtggttggtgatggacaaaacattcggggaaggcatgaattcatattcttagaagaggttattgcagaaaatctggaccttctcttcccgggaatggacgtcagggcagcctatccattcagagtgaccagggatgcagacattgagatagaggaagatgaagcagatgacctgctcgttgcagttcaggaatctatcggacgccgctgggtaggcagacctgtcagaattgaagtctcttcatggatggatcaatcggtctgttccatgatggcagagaagatggccggatttccccatatgttctatcggctgtcagggccggttggtatggctgatctcatgtgtcttgtagacattaaccggccggatttgaaagatactcctttcatcccctctgttccgaaaaagatagagaacgaacagaacctctttacaaaaatcaaggcacgggattttattctctttcatccctacgagagttttcagccggtcatccagctggtaaaccaggcggcccatgaccctgatgttctcgcaattaagatgaccttgtaccgttcaggtgcaaaatcaccagtcattgcggcccttcttgatgccagagaaaatgggaaggcagtatcggttgtggtagaactcaaggcacggtttgatgaggagaataatatcggatgggcgaaagccctggaacatgccggagtccatgttgtctatggaattatgggactaaaagtccatgcaaagctgtgtctcattgtcagaagagaacgtgaaggaatcattcggtacgtccacatgagttcagggaattataatgctacaactgcgcgaatttacacagatattggtctttttacggctgatccagagatcgcttcggatgtttcaaatctctttaatgccctgaccggatactcaaattatatggcctataaccatctgatggtctcgccaaaatacatcagacggggaattctctctcttattgaacgggagattcagcgccagaaagagcatcaggacggccatatcatcctgaaattaaatgccctgcaggatgcagagatgattcgggcattgtaccgtgcgtcacaggccggtgtaaagattgatcttcagatacgggggatctgctgtcttcggccagggataccaggagtatctgaaaatatttcagtatccactatcgtcggacggttcctggagcattcaagaatttactatttccataatggaggggatgagattgtccttatggggagtgcggacctcatgccacggaatctgaacaggaggatagaggtactatttcccatcctggatcagaggattcgaagagagataatctcaacaattctcccggtacacctgaatgacaccgtgaagaagcggattctgacaaaagatggatcatatatcagggcagttcctgaaggggaggctttacatgcacaggaatggctcattgcccaccgggggatctggaatgaacatatggatgaagaaaatggcaagctgcataaaaacattgacatctagttcaggaattgtaaggtaattgatgtgaacaccggaaatgaaacagttcttggcatcgatccaggatttgccagatgtggatatggcgttgtcggtaaggaaaaaaatactccggttgcatatgaatggggatgtattgagaccaccccgaaaaccggagatacaccggtcagattactctcaatttatgattcaatagagaatcttatccgcacctatgcccccgcctgtcttgcatgtgaaaaactcttcttctcccgcaataccacgactgcgatgcaggtcagtgaagcaaaaggagttatcattcttgctgcggcgaaacatcagattccggtctttgaatatacaccaaagcaggtaaaactcgcgattaccggatccggtctggccgacaagaaacagatccagatgatgattacgcgactgctccgtctttcagagataccacagccggatgatgctgctgacggactggcactggcactttgtcatgtgaactggatgaggatgagatgatagcacgaatcaggggtctggttatcggatatgaaacaggatcggtcattgttgaggcaggggggattggttatcgcatccgtgtcccggaatcagtccttacctctatcacaaaagatgatgagattattctgtatacagaacttatcatccgtcaggatctcatgcagttgtatggtttttatactcctgaagagacagagatgttccgccttctcatatcagtatctcacatcggcccacagaccggacttgcaattataagcagactatctcttcctgaaatctgtgatgccatctcatccaaaaaaccagagatattatcacaggtccagggacttgggaagaagggagcagaacggatcatcctggagcttcagaaaaaggtatcagaactgaagattcagtatccgcaaacacccacttcatcaacaaaaatccaggacgccgttcttgcattgttatctctgggatatagtcgtgaggaagcaatgggagctttagagagatcagcactggatacagaaaccgtatcctcatcagaacttgtcagggaagccctcgtattccttcggaaaaagtgagaaaccatgcagaccagatttgtaagcccggtaaaccatgatgaagagcaggatgaaccctccgtcagaccagggcttctggcagattttattggtcaggattcgataaaggatgcgctaacggtggcgattacatccgccaggaaacgaaataagccgcttgatcatatcctcttctctggaccgccgggtcttggaaaaaccacgcttgcacacatcatcgcccaggagatgaattcacacatcgagacgacaagcggtccggtgctcgacaggcctggagatctggcagctctccttacccctctgaaggatagggattttttatttattgatgaaattcatcggttgtctccggtcattgaagagatactctatccggccatggaggattatacaattgaccttctgatcggtgaagggccttcagcacggaccatacagcttcccctggagcggtttactctcatcggtgcaaccacccgtcttggtcttctcggttctcctttcagggatcggttcggtatcatcctgcggcttgatctgtatgatccatccgaacttacggtaatcgtcactcgatcagccggaattctgggcattcccatcactcctgaaggggctgcagagattgcaggacggtccagaggaacaccccggattgcgaaccgactgctaaaaagagcatatgattatgcaatcgtcaggggcacgggatcaatagaccaaaatatcgccaatactgcactttttgcgcttggcgtggatcagaaagggcttgatatcctggacagaagaatcctcgaagtgattgccaatgactttgacggcggcccggtcggtctgaaaaccatctcaatatcagtcggtgaggagccgaggaccattgaggatgtatatgaaccataccttatcagaatcggatttctaaaaagaaccccccagggccggatgataaccagtgcagcacgggatcatctgggaaattcccataccagagatctcacctcctttctctgaatatttcctgcaagcttgtaagagataatgatcaatagatcagtatgatctggtccaaacccacaagtactctggtttttttattcatctgtctcatcataatctctccattacaagcggatttaacgtcagaagagacagacaatcgatcaactccctatacccttacccctgacctctccctctctgatctcatcattcccaattcggtagaaagcggtaaacctatttcaggttctgttattgtaaccaatcgtggcccggtaccggccagtcatatctcaatggatgtgctacttacgcagaacgcaacccaggggatccaatctatctggcttggaagcagagggacagatgtgatggcaccaggaaccaggggaaaaatcccattttcctttgatgtgccgatggatcttcgggatggagagtattttgtgaaagtcagtatccgggcatacgaaccagaaattattttttctgataataccatcacttcccctgagccggtttacatccggaaaaatcttccctggaaaggaggagatccaaatctacaactctctattgattctgtcagcaccaattcctcatcgccaaattcacccttcacaataacatacaggattctaaacacaaatactgacgctgccggatcatgcaagttgttattcctcctctctccggaaagggatatcatcgatggatgccgccttcgggaggaacaagtcttttcaatatatggatacatgaatgaacagggaatatctgatgacctgatacctgaacatatcccaccaggcttctattacctgataggaattattgattatacgggtatgattcaggagacggatgaaacagacaatatttttgtctatcctgatccgatatctatctcctatcctcaaaatctctattcagaatcatacaatgaccagataaccgggtacctttttctgaaaacaaataaatacagggaatatcttggcctttcaccccttacctttgataccgatctctgcacccttgccctggatcatacaaccgatatgatacggagatcctacttttcccattatacccctgaaggaattgacccgaccggaagagctgaactgatgggatatgatgtaacacgaagaatggacgatggcagtatcaggaccggtattgctgaaaatataatacggatagcagcaggacatacgatcgggaaggcatataccggatttgttgatcctacaacaccagaagatgtcgcggatgtcatgatgattgaatggataaatagtcctgagcataataaaaacctcatcaacccgacgattgaaaaaattggtatcgggacccgatttgacggggagtatttttatgcaacccagaactttttttaaattccttattttgatgacgtctgattcatagagttgaatatcgtgacaatatctgcataatcagcacgcccgtttttattgaaatcaatccgaagggagaggttgctctcaccaatccatcggaagttctggaataaaagaaccagatcatgcatatcaagacgtccattcccattcagatcttcaaaccgcccgtcattatcggtatctttcatctcctgaaccatcgatgcattaaatccgatcgggatcataacattggcattatattcaagattcaactcatctgatcgttcaggatcactgatcctggtggtactgctgatccgtgcggatgatactccggcgatcccggtctgtgctgatgcctgcttatacggagatttttcttctccggatgatgtggttccaccaagagcacaggcaggtgttcctgaatcttcctggccctcgctcatccgggtagcgactacatgctctgaagcctgaatagatctatccccatctgaagtatattcaactaatcgttcagaagagatgctgccagaaccggatatctgtcttgtttcatgagtctttcctccattggtcataacatcctgggcatatacagcagtaccggaactgatttttcctgatgtggtatcattctggctgtatttctgttccagtatggtcttatcatgaactgatccggttgtggaagtcatctctgaaagttcctgctgttccccgccatgatataatctggtgaaggtggtaataagtcctgaaatgagtgtcctgtcatagagcgaaacttctccggattgtgttttggtctttccatgaatggcagagatgactgttccttctaatcctgggtttgaagcgttgctttgaggggttccaattgaaagggagtaatccagagtcccattcgaacttctgcctgccgatgccagggtcagagtctttgcattcgctattgagaatgatgctgactgctctccggaaatacatgaagatacaaggtagggatctccaaagcaaatagccccctgtgtcttattcgagtacatatctgaagaggtcagaacatattcatctgcaatcagatgccctcctgatgttcctgatgagtaccccactactttctgtgtctcaaatccctgccctgatgatttttcagacatatctacctgtttagtcagggaaagagaaccgccattggtcatgactgaatctgaataaacaccggaaacatttgtaccattcccatctgcctgagaaaaggtgccggtaaaactgtcccgaaccgggcctgttgcctcaattatagtcccgattgaataatctgctgcggttatgagacatatcatacctgacgctaccatcaatcctgcaagtaaaaaaatccggacacctgacggtaacagattcatgaacgcagatgtagtattgatgcacgaagtataaaattcgttgtatatataaacgatgataatcccaggtgaaaagattattgtggaatgcgaacctttcaaaaataattcttatagttcgtgtatactttgaaatgaatgagaatgcacgccttaataatgtcttcttttcaatctgacttatatatcggttcaagtttcttattatacaaagagacctcgttttaaaaagagattatatatgataattacgaattttccagataatacaattttaccatatgatccggatgatatcgctctttggcttcacgaagtccgggaattcccatatcactctcccggttaatgtaatgatatctgtccttcagatatagtgcagtctggatattaacttccttgtatataccctcacagtcaggtaatgccttttcataatgaacgacggctgttgtaggattcagttcttcgaagattgcaatccctccaatctctcctttcgggtttaccgtaattccagaaaagccaagttggtcaaaatactgaactgcttcattaattgcctccttttcatgttttaaaatagtatatttatcacattcacgttgctgacaccattttaccaaaaattccaaaacttcatccatgttggattcagaaataagttctaccgttgatgggcatttccgtcgaaatttatttaattgttttctgaccgacaaaaaatcctgaccgggaagtgaggcaagaatctctgatttataaacataatcaaaaaattcacgatccggctttaatttcagggttggataatgctccctcatccaggaatattgccatggctctaatatgagaagtggggcttcttctccaagattctgcgcaagtttaatggtcgcatgaaatacatccggttttacagggccgataggaaaccggtatgaatgataattttcagtctcacctttgatgatgagacatccctcatgttcacaaatcttataatgaccatacgaacgccagcagaataatgttccaaatgtattttcagaatgttgaatgggataatcccgataaatcctatcaaaaatatccttatcctcaagctctatcgggtggaaatcttcttcatgtatcttcattgtcacgccctttctggtataaaagaaatatcttatctttatcagcaataaattcagattgctcataaaacggactggtgccaggctctgcgaccagaataatccggaaaagtccggcatcgcgtgcggttttaatcaagaaagccagaagattatggccaattccctgacccctgaatttttttaaaacgcacatatcctgaattattccggtactggtaccatcagagattatcctccctgttgctactgtttcaccggccggctgatgcaccccgacacaaaaccggaaagatgctctgataaattctggtatctcatcaggatggtattcatccttccaccacccggcttctttgtaaagggtcacaattgcatctgtatcccagatatcagttattaaaaattgaattgaatcgctggaagaattattcatggcatgttacctacaggatattttatataaatacatagaaatcagcacataaatacatagatacaatatatattttcatgatactatacataattactatcaaatatggaaatacgtcgggttcaaatgaccggagggtcatcctatgtgatcacccttccgaaagactgggtagaatcaacccacatcaggaagaatgatcccctgggtgtaatagtacaaccagacgggacgctgttaattactaaaaatacaaccggagatcagattcagcgcgtgaaaaatctggagattgataccggaatcgaccctgatctcttcttaagactccttatcgggatctatatcgccggatataatgccattcagataactacaaaagaccggatgaccgggaccatacgaatgaaacttcgggaattttccaacatggtcatcggccctgagttcattgaagagacagataccagtatcctcataaaagatcttttaaatccgctggagatgccgattcaaaattcgctgaaacgaatgtttgtaattgtaaaaagtatgcatatcgacgctattgatgcatttatcgcgcatgattctgatcttatcaccgatgtgattgaacgggataatgatgtggaccggttattctggctcattgcccgtcagacaaatatgattctgcataatgttcacttatcacgaaaaatgaacatgaacatatcagaaatgcttcctcactttcaggtagcacgaatcatagaacgggttggtgaccacagtgtcagaattgccctgaacgcaaaaaagatccaggaggcagaaattgccggggagatacagggccacatcaggaaagcatcagagggcgcattaaccacatttgaaaagagtgttgagtcattcttcactcatgatctgaaaaaggcaaataaaatgatagaatacatgcatgatctggaagaatcattcttaaaaataaataccgagctcctctcacttccggtgaacattgccgtgccgctaagaaacataaccgacagtatcaggcgctcaggagagtattctgctgatattgcagaaaatgtgataaattatgagatgatgtttgagaagaaagctctctgattatttaaatctgacccatatcacgaagaagtgtcttaacatcaagccaaattacaagttcagttctttctttatccttatcttttattttctttttaattatcccaagaatatgagatgattcttctcctgatgtcgccgtctcatccacatgacttgccgaataggtcgagacagtgagaacatcatctaccatgataccgatttttgaatgggtaatccgatcatccaggacaataattcttttttcctcttctgatgcagcatgggatgaggtgattgccagttgctgtttcaaatcaataatggtggtaatttcacctcgtagatcaataatacccttaatatatgtcggactgtttggtagtttggtaatcctggtatactcaacaacctcttttacatcaaaaaggtcaatcgcaaaatgttcctgtccaaggagaaattccacaacctgaaatgactcctccgcaccctcttcatcagtttttccagtcattttatgaggagataatccatttaaatcagaagagggagaagacgcaatacccggaattatgccggccatggattacagttagaacgtgtaaataaaaataatatttgaaaacgtggagccaggttagcatccgcaaaaaacacatgggccaatataaaggcggccgatgttaatattatttgatttatccagttcaggcatttcatctccacaatacggcataaatgtgcagggatcgatgacagagaaccagtaatattcaccattactaaggtcggcaggtactgaaacagtgatcgtattggtcttttgttctccgacacataacctgctgatttcccagaccccaagatatcgtgccgttgagggatcgaatgatgcatagggtgacagataatacgcaacctgtgtatggtctgcacatgcatttccaatattcgtaatggtatcggtaatttccacagtatctccgggctgagcacaggggaattttgttgtgacatgggtcagatccggaattcgtgccgacggattatattcaatgcggacaggtcggttcccggtccagaaattgttggctgtatttttttccggaggactcgatgtcacggtaatcttttttgtcaggtaataaatcccggtatgagtgccaccaggtatcccaacggtaacctgcccggttcttgtctcgccacctttcaaattatgtagggtccaccagtcaagatgtcgtgcatctgaaccgtcgtcatcagatgaaaggagatattcaacccggactatccctgcagtagaagatccgatattggttatcgaatcggtaatctttgaagactctccaatatacatgacatcaggataatctgttttaacagtcatgatatctggctctatggatgatgaaagaggtacaacatcagggacagaagtgacttgtgtgggaatggtgactgaaagcgagattggttcttctgatacccagtataatgaagagtcatcggagaccatttccaggggaaggaatgctgaaatcaggaaatattctccatcgggaatgtcttctgggagtgataaggttgaatcgactctgatctgctcatctaccggaactatcagattatcagattctccaagggatatcagatcatcggagatgagaccagactgagacaggtaatacgatatttttgtctctattggatcttgtcctgccgtattcgttattgtggaacgaataagcagcgttcctgcatcgccggagtaaatgaggtcatctgtgtatccggtaagtccctcactataatccagtattttcagttccttcttcccgcctgaaaggtatttccgtgaatcttcagataaggattcttccggatttatcagccgggtcatcatataatttcctgcccggatatctggcgggactggaaaggttgtgtttatctttttttgcccgccacgaacaaggttttgaatggtgacggtcccgagcattctctccttaaaaactccgagagggtcttccaatacatacccgatggaaaaggggcctgaagcgtgcaatccctgatttctgagaatatctactatccggagatacgtcccggcctgaacatggtccggaacagtcattgataatccggtaatttccgggacaatggatgaatcagccagtactcctccgaatgaacaggagaaattttcctggttatcaaaaatgttaggaaccccggtgaatgagccaaagaagcagagaaatagtatgataataccgaatgtcaatatccgatgattcatgtatgaggatatctcctgcccgataaaaacctttttgggaaaaatcaggagtccccggaatacctgctcagtattccaagcacagtaattagggcaagaaatgcagacaatggagataacggagtctcttcctttggtgcagattttaataaaagctctttatcgatccggtattttactacatccggatctattgcgatggccatatcatacgccatgcctgcttcttcatatctgcccagaaggccgtatgccgttcccatattatcataggccatagaagaattcggaaccagcataatcgtttcattccatgccattatcgccttctcatactccttcattgccgcatatgccagaccggtattataccatgcattcgcagagagggaaggatctatttgtttcgcctgcatccagagttcgattgctttttcaagtgacccctgtgcatagtgttcattcccaatctcgaacaattcttctccggtgtaaacaggcgcacctgatgcggccaaaaccaacatggggataagaaatacgattggatattttttcagcatcctgatactcgtacctatctgtattctgccattgttaagattcttctccctcaggggagggttcgcaaaaaaagattatgaagatcctgctgctccggtaacgatcttcaaagaggcgacaatttccgggaccatctcaataggaatgcccattaccatttctccatcctcgattccggagaattttctggacccgtcacatccaagggaataattcggagtgccggaaagatacacctgcgcacaggcatcagaacaaacggactgtattccggagaagtttgatgtgattcgaccaccaagacggtagaggtggctttgagcaagttttaacatcgcttttggttttgcaacaatcagaacaatggtcggatcaaagggcgttttctccaggggagcatataaggtagcatgcgtggtcagcgattccacatgggggacgcgatcaatggtccttttacaggcaggccatgattcaaattttcccagtttgtagtaaaattcaccggatttcagacttggtgtcagttccctgagtccaagagcccaggacccacccatacaggagtgattttcaagggtcgcataaaagatcttcccttctttcctcgccatccctaccatctgacaatgacggaccgtttcagagatatgaggcatcccctcaggaatgtcttctgctgtcttacagaatttgaatgcgacaggagacccgtcaagattcagagtctcttttaaaattttcgaagcctccgcgtaatcaaatctggttcggattgtgtcctgcatgatactcagtcctctcgtgcatatcatacagggacagaattaaaactttctttttggttacagatgacgaagttttcggtttatcttttcaaaaaaattctgccctgcgtcgataaataaggcaggacttggactttttgagagttctatagtgctgctggtctccaggtgtatctcagtctgtccatcgatgacaagttttgcaggctttgtcgcctcaagggttattgataccgttcttgaagagtcaataagatgtggacggtttgagagcataaacggggcaagggggaccatgagaaatccctcaacccgggggtctacaatagggccacctgcactcatggcatatgccgtagaaccagtcggagtactgattatcaatccgtccgctctgaaccgctctgctacgtttccattgatatggatgaggaactttagcatttttgccggccgatctgttacaatcaatgcttcattcagtgccgtcccgatatgttgcccgtttatccgaagttcaatccgcatccgcgcttctaatgggagcggctctgtaaggtgagagacaaacgtgctcatctcttctggttcaatgtctgccaggaatccgacttctccataattgattccaataatcggcacctgaaccggcattcgctgagtcgtaagcagtattgtaccgtctcctccgattacaataacaaggtcaggtggatgctctccggaaaagagtggcggggcctctccaagcaggttttctttatatattgatgtgtgatgcccgtgatggtgcaacaatttctcgagctcataggagaattcctcaacgtccggatcgccatagcggttaacaataagaatattcatggttgtggacaattctgctcaccgaagatattcaatcacttttttatgaagagaggcatttgtcccgacaagacagttgccgatacttacctcatcaggaagggtaagagggttcccatcccggtcacttacaatcccgccggcttcctcaagtatcaggatacccgcagcggcgtctgttgccctgagtgtccttcgaagatcaacaaaaccatcgatcttccctgcgcccacataggagagttccagggctgaagcaccaaactgccggaacctccttatctttcgtataagatggattacccgatcatattggaaatgcttgccatatacactcattgcactggcctgtaattcagatacatcagagacatgaaggggaacaccgttcaaccaggatccttcacctcttttcgcggtgaaaatatcaccgttggagaggttgccaacaaaaccttccttcaggactccatctttcacatatgccagtgatactgcaaaaaacgggatattcataagggcgttataggttccgtctaccggatcaagaaagattgttccggtatctccgccgataacaactttcccggcctcttcactgatgagaagacggcataattgttccttcttaatgacggatacggcaatatcctctgcgattttatctatatatttcgtaggggtgccgtcggccccgtttccggtatttactgcggcctctggagttccgataagaggagtaatggctgatcgtattgcggtgaatatggtgtaactagcttcataaaaatccatgagagttccctgagctcaaattcggacggtgtatttatgtaagggtgacacgtaaatataaccagcttttcccaaggtgttttatgaaagagcagactgaagttggtaagctgaaagaaggaaaatatctgttagttgatgatgaaccgtgtaagatcctgtcaatatctgtatccaaacctgggaaacatggtgctgcgaaggctcgtcttgatgtcgtcggtatttttgatggtgtcaagcgatcaattgttcagccggtatcagcaaaggtatatgcgcctattgttgagagaagaaatgcccaggtaatttctattgccgggaatgttgttcagatgatggaccttgaaagctttgaaaattttgaggttacagttactgatgacgtgaaagacaggatcgaggcaggaaaagagacgatgtatatctactccatggaaaagagaaaaatagatttcttataattttttttacctgttttagaatctgattattggaaggatatccatcttccagtatccgctatcgattacaaatggaatttcatgtgaagtaacatattcgcttccattcctttcccatataaaggaacctttcagatttccttcatttaatcgatagaacgaattatcaatcttgtattcagagatatttactccggatgatttcatctgatttatttcccggatacatccatcacatccacggtttttaagtacttcacttgaaaaaagattacagaattctgttttgtttggttccagggttaagtcaccattataaagcatgatgaaataatccataatctgacggaaaattgatgaaggggtacttctgttgagatcatttttggatacatcagttttctccagagaaacaggatctggtaatttaatgtctaatgaatatgatgtaataaaacgagagtggatatcgagccggtaagtattatagccctcaaaaaatttttctttccaaggccttggatcccagttaacctctatctcatcccctttctcggataaaatagttgttttactatcttcacctcttccaaaagttcctttccagacttttggatcaagaccgccaggaggaattactcttctaattacctgatttgtttcagcatttatcacagaaaattcaaaatacgggttcaccgcagataatgactgaactttcggatcatcttctgattgttcttctaacattgggttttgcaaatcctcaggcaattctacagtataccaaatttcccaatattttgaaggaattgtaatcggactggttgtttgagaatattttcctgaaattgtagtatatgtctttaattggactgctggttccatgaaagaatatctttgatatgaagatacatattcacggggaaccatcccctgctgagtaagattccctggtggtaaaaccaccggagatccattccaaggttggatttgagttactgtaggagttaaagtgatatttacttcactttcatttgagctgacattaactgatgtgttatatgtctggttgtcagaaggtaaggacatattggaattatttatggaaaaattcacctcttcaaccgtttcatttttttgggaaaaaatattcgatatctcatccgggataagttttgcctctttcccggtcacaagaggttttatgtacatcgccattatcagaacaataagtatagcaacaacaatgacgatgatatcccgtttttccatatgtacctaggtatcgcgaatgtactttaaaggtatctggatagtaattctgtactctttcaaattatttccaattatattcagatagtaatcctttccaccttcaaagaaacggtactcccgtggatcaggagattttccctccttccaggtaatagtccggatagttttttctccctcatcagatttttcctttacatccattgaaaagactgcattttcatcagcaggtgtgacattatagtgcaattcccaatatggagtcggaattctgaaaggtgaggtagagcctgtatactttccaacaatttctgcatagttcgtcatctgaattgccggcatcggattatcaggatttggttgccaggtcatcggagtcatctgtggtgtaggaagagcacctgatgaaggaactgaagtcttatcaggaagtacctgctcctcctgagtctcgccaggggtcgcttcctgagttgccggagatacctgatagtccggttcaggagtaagatagggttccatcacaggttcaaccggcgcaggagattcaggtaaaaatatcaccggctgtccggtaataatcggctttaccaccaccgccattattaatacgacaattattgctgctaaaatgactattacatcccttttttccatctggcagccctcttctgatagaacatacgcgactgaaatatttatatcgtgaagtcatgacccttcccatctcagaaaaatccgttacttcacatagagaatcatgatcttatttatgccaaagtgaatcgaataatatggaatcactgtatgaggatgaaaaatatgtctgatgcaaaaaaaccaacccctgaatcctgtgacaataactgctcatcctgtccatcaggcgctacttgcccgacagcagccggaaaattaccgccaaaagctgacattgatgtgagacacgtaatactggttttatcaggcaagggtggagtcggaaaatccacggttgccgtaaatcttgcttatgccctctcgaatcatggaaagcaggtaggtcttttggatcttgatatacatggcccgaatatccctaaaatgcttggtatagaagatcataaacttctcgcagaccagaataaaatcgtcccggtaaaagtaaccggctcattacaagttgtttcaatggctttcctgcttcctgaaaaacatgccccggtcatctggcgtggcgccatgaaagcaggagcaattaagcagttccttgaggacaccgcctggggttctttagactatcttgttgttgacctcccgccgggaactggagatgaagcattaactatcgcacaacttgctccgaatgttcgtggtgcagttatagtcacaactcctcaggaggtatccaccctggattcaaccaaagctatcacttttgtggaacagcttggactgaatgttattggtgttattgaaaatatgagcggatttgtttgtccgcattgtggagaagcagttgatcttttcggcaaagggggaggcgagcggattgcacaggatcataatgtcccattccttggaagccttcctcttgatcctgaagtgagaaaggccggtgacgaaggaagaccattcattatcagacaaaaggattctccgacctggaaagcggtagataccgtcatggaacacctggtcagcattgttgaaaaacagatatgaattacttggaagttctttgtgggagagaagaaaatctcccgatttatgctgaaattgtgaaatgccttgaggacataaatcaatttcctcaactcatcgaaccgatttatcgtgaggcaataacattaaatgaaacccttcttgaaaaactacggtttggccttctacgacttcagttacactctgaaattcatcggaacagtgatatggaagaggcacagaagatgcggttcgtttcagagatgatagagcgcaccatatttggcggtctctttattgaacgggaaagttacgtatcagagtaatcaccatgtcccaggatcgcaatgaattctttgtcatcaggattccggataccggatctcttcttgatgcggtccgtattattgctgcatcaggacttaccataaccaggtgccatttcaatcgttcgctggatccggttaccgcatttttttccgtatcaggtgatgaatgggcctgtacccgtggtgcgcaggctttgctggatgatggatatctgcagactaccgtgacctatccaaaaagtgttcagtttactgttatcgttcctgaaattcccgggactttgcacagaattcttactatcctggatacatataatgcagaaattagttctctctcatttgataaccgtggcaaatatccggatgccctacatatcatgctcagggtcttaaatcctgataaaactgaagagttaatcagaacgattgaagctgaatatccggtaaagattgaagggtatgactgtggagacagttgcgatgatggaagcctgttttatgtcagatatgcggcacgggtcagtgaaatcctcgatggcgtagaaaacccgcatattcttgaattgttacaccagtttagtcatgtcgctcaacaactgaccgaatatgggaaagaataccaggatgtgcttgaacaaattctgctaaacggaaaacgcctgaaggaaacaaccggggatggtttttacgcagatgttcaaaagattgcccttgcggacacgctgacactctattgtttccagcttccgggcggaggctctatctttgtcatcgatgcaccggatgaacgaatcatgattgacaccggatatggtatttatcatgaggatgttctccgcatgtttgctgcctatggccttggcggaaaagatgactttacccggataattctaacccatggggatactgatcattgtggtgctgccggattttttaatgccccggtgtatacccatgaggggacctgggatatcataaaaaccaataatcgtgcatggggagccacaacacaggatttggtccttgaacaggtatatacagtgatgataaatctgtttgcacggatgacgcctccggaggaagtgactcttttacccggtccaggggttgtaaagcggggtgaatttccagttctttcaaccttcaatgctggcgggtacaactttgagatactagaggggcatgggggacatcagcatggtctgatatatatcctctgcaaggaagccggagtcttatttacttcggacaccatcctcaacctgaaacacctgagtcctgaacgaagtgcgtacaataatttcgcagtatatctggtcacgacggtgaatgtggatccggatcttgtaaaaagtgaacgaaaagcattggcaaagctggcactggaacttgatcaggagcttcaggaaagcggaaaacgccttctgtactgttgtggacacgggcctgtttcagtgatggagaacggtgaactgaccccggtgaccgagccggctacctaccgtcactgaccagtagatgggttcaggtgcgatatcctgatgaggattccatctgaacgtatacacagatatgaatcagcaccgtgtgcaggatatgatgcaactgatggcgtcacggataaatgccatcgcagatcatatctctgatgaagaggtttctcattttattaaagaactcctggatgccaaacgcatttatgtgatgggtgcaggtcgttctggtcttgttgcaaaggcatttgccatgaggctcatgcaccttgggatgatgagctatgtggtaggtgagactatcacgccggcattgcaaacaggggatcttattgtggtcttatccggatcaggaaagacaagaaccattgtggaaattgtccagacggcaaaagagattggaggacggatttctcttatcacttcaaacccagactctccgattggaaaaatctctgatacaaaagttatcattgaaaactaccgtgacagcattcctgatgagagtaaggagtacgataccagacagatgcttggtgagcaccggtcatttgccccgcttggaactctgtttgagacagcagcgatgaccttttgtgatgctgttatatcacggctgatggaaatcacacagacggatgagtcagaactcaaagaccggcatgcaaatatcgagtgattctgatgaaaaaaatttcagcacgtgcccaggcaatcgaaatgtcgggaatcagaaaatttttccaggctgcaaaacccgattctatcaatatgacacttggtcagccggattttgtcacccctgaccatatcagaaatgcagcgataaaagcaattgaagagggaaaaaccggatatacattcaatgcaggtatccctgaattacgagaggcattatccgacaaatttaaaaatgaaaataatctgcattacagtccagaacagatcattgtgacagctggagccggagaagcgctctttattgctattcagagtattgttgatcctggtgatcgtgttcttttaacagatccgggttttgtctcctatgaggcgtgcattcagcttgcagggggaaaaccggatttcgtgccacttacaaaggatttgcacattcaggaagatattctccgagagaaactggaaggggcacgactacttattcttaattcaccctgtaatccaaccggaacagtcgagtccaaagaaaaaatccgctcgattacagaagcagccatggatacaggcgtaactgttctctctgatgaagtatatgagcatatcatctatgatgcggttcatgcaagcgccgggacctttggagaagacgtgattactgtcaatgccgcaagtaagacctatgctatgaccggttggcgtcttggatttatagccggtccaccggaatacatggaacagtgtctgaaagttcatcagtattgtcagacctgtgccacctcaatcagccagtatgccgggatagcagcctataccggcgatcagtcctgtgtgaagatgatgcgggatgaatacaaagcacgcagggacattcttgtttcaggttttcatgatatgggtgtaaaattccctgaaccgcagggtgctttttatgcatttgttccacttggaaaggagagaacacaaaaagtaatggatgccggcgtaatagttgttccaggtgatgcattcggaccatcaggtgcagaatatgcccgattcagttatgccacttcacgggaaaatattatggctgcaatcgaacgaatgagaccggttcttgaggtataaaatggtttatgatttattaaaaaaactctccgatgcacatggactttcaggatttgaaggaaatatcaaatcaattatccgaaaagaactggagggatatgtcgatgaaatttctgaagacagacttggaaaccttatcgcagtaaaaaagggcacaggactttcagttatgattgcatcccatatggatgaaatcggacttatggtccagtatatcgatgaaaaagggtttataaaatttgtagggatcggaggatggttcaatccgactcttcatacccagagggttgtcctccatgggacgagagggccggtttttggagtgattggatcgaaacctccacatgtcatgacaccggaggaccggaaaaaagagatcaagatggaggatatgttcattgatatcggagcatcatcagcagaagaagttgcagagcttggtattgagataggaactccggtaacgattgaacaggaactcattcatctggcaaataatcggattaccgggaaagcgttggataatcgggtgggtgttctggtcctcattgaaacactgaaaaagatgaagacctcaatgaccgtttatgcagtatttaccgtacaggaagagatcggtttgaagggggcaaaggtcagtgcgtttgctttacaccctgattttgcaattgcaaccgatgttacgattccaggagatcatcctggtgtaaccaaaaaagaagcatcggttgagatgggaaaaggaccggtcctggttctggcaagtgcatcagggagagggttactggctgataaccggctggtcgcatggctacgatctgccggagataagatgaaaatcccataccagctggaagtaggcgacggaggaaatactgatgcctcgattattaaccttgtcagggatgggatccccagtatccccttatcagtcccatctcgatacatccattccccggtagaggtggttgatctcaaggatatcgaggctacgattgacctgcttgttgaagcactaaaaaagaaaccaaagatctgaagattgaagatcacaaatcaataaaacctttattttttaatgattatctcatactattatgtttctgaagacacctctccatctcttcatactcctgtctttagtttttttctttttacccgcaagccatgcagcgaataccagtactgaccctgcacctggaatagatctgatacagaacggttcttttaaggaaggactggccatcctggaggagtatgtcaaatccaattctacaaatccggaggcttggaattcaataggatatgctctgaataatctgggccggtttcgtgatgcaatacctccccttgagaatgccaccagattagaacccaatcatacgattgcctggacaaacatgggatgggcatataatgaacttggagattatgaaaaagcgctggaggctttggagactgcaacgagaaccggcccggacaataaatatgcatggagtacaaaaggatattcacttatcaggactggtgcacttacagaagctatttctgttctgaataaagcccttgaactggatgctaatttttcagatgcatggaataacctgggatgggcttatgcagaagataagagatatgatgaagcagtagaggcactttccaaagcgaccagtcttgatcctgaaaatggatatgcatggaataattttggaaggatcctctatctgacagggcgaacagaagaagcacgggatgccttatataatgcaacacagactaaacctgaatttgaccagggatggtataatcttggaaatgtgctctatgcaatgaaatcatataatgaatccattgaagcataccgaaaggcagttcagctgaatcctgataaccagatagcacgtgaaaatctggagattctagaaaaattattcatataatttttaaagctgaactgatagcggactattttgtactttgctcatacaggtctgacagagcattgatttcttattgtcaagatcatcaagggtgagcgggtttgccatgatacatgaagtattggtgcagtgatcaagatgtaagagatgaccaatctcatgggctccttctcgtgataaccggtcaataagcatcatctcatcagatggaagaccccagtattcatttcttagtctggcagatgagattacagcagtccctgttgctggacgggagagaccaaatacatatctggtgcccggtctgaagatatcatctccggttaccagtaaaataaatctcttttcttcattccggcgggaaaaaacatcaagacaggttaatattgcacttgcatcaaactggtttctgctcctgtcaaacccgttataaagaaccgggctttcacacacttcagccggaatatccatgatttgagagatgatccgggcaaccggtatttcaagaccggccggagcgtcccgatcccaaaaaataaggatattcatctccaataaactgggtaatgagcgggtataaatatattgagacggcgattgccaggttcatcgccggacggtaccgctcagtaattgaagttggagccggaacaaacctccatactgcaaacctgttattcagaaccgggatattgatcagatgtgtggatatcatcgatccgcccctcaattcatggatcccgtacgtgaaagatgatgtgtcagatcccgaaccagggctctatcagggttgtgattgtatctatgcaatacgaccggtggaagagatgattcctccacttataagacttgcacactctgttcatgcagatcttgtcgtctaccatctggggtttgaaggagcagcccggccggctccccttcccggatgtgaagtccctctccatatatatgttaaaaactgaaaagggttgactgagacgatttcttatccttttccaccggttcagtggacggttgttcagggggatttcccggttcctgactggagaatgaatcaatcgaaggggtctcctctactatgggttctttctccttcttcgatcccctggctttcttgccctttgcatcctcctctttcttcttctttttcagttccttttcaatctgcttcttctcatcttcgatcttctttattattgattttgatgtggcgggatcatgtatcaggatgtcaagcttatccacatccagatcatagctcttcgcaaactgctcagggaattgttttgcaagcagagagatcggacagagatataagttccggactgtagaggctgacatatgcattgatgttcccatatcggataacaactgttcccgtattgtcttctgctttttcgcaacagacatctgtctccatcgtgacggaggcatgatcttggcatatcctgatggccgacccttcattacatcatgtaccccgtagagcatgactgaggttgcataccgccataatgtgtaatattgggtgagaaatgtatatcccaggtacatatctgccctggataatgcagcataggcttgtgctgtcttttttctgtcagggagcacaccaagatttccttcaatccattgaaggatagtatccggtgtttcatccacagacattgacatatcaagaagtgaaggaacctgacggtagcctaacgttgcagcaacaagatcaaaaatactggcacgactgtcttttgcagatatagatacatcatcttcacccacggtatctttcccaatggcagacgcatagagcatggtcactgcagatctgatgtcaccaccagactgctcggcaatgtcagttaatgcctgggcagagcaggtcagctgttcgcgtgaacagatctcacgaagtcttggaaccagtgattttgctggtagtgctttaaattgaacttttgtacacaggttccggatagtaccatcaagcccatagagatcattggctataagaatcagcggctgacgtgcctgccgtattacttccgcgattgcacgtgctcctccgcgatccgcatttccctgaagattgtctgcttcatcaagaatgatgagttttctcgcggcaccggtgagtgagccggtacttgcgcttccacctgcaaccttttcaatgactgctttggttcgttgatcgcttgcattgagttccacaacttcccagttcatgtcatgtgcaagtgcccatgcactggaagtttttcctataccgggcttaccatagagtatgagaggaggggattccacagtccaccgggtcgcccattcactcatctggtgcaatgcctcccggttgcccaccatctcattcagatgccggggacgatacttctcagcccagtccatcccgattatatgtgccgcctatgaagataaaccacatgaacttaactgacaggcatggagtttggcctttggtaaattctgaaccaaataagacattttatgagtgatgaaacagaaaaaaagagtgagaattagggccatgggagaatacacctgctccaccgaacagatagcacaggctgtcagaacatatgacggagtgagacggaaaagtgaaattggtgcaatggttcgggatcttcagattgattctcaggctgttgtcgcatcatttggggaagatgctgcagtaattaaaaacggatctgatgcgttgctcctggcagcagatgggatctggagtaaacttatggatgctgatccctactgggcagggtattgtgcagtccttgtaaatattcatgacattgctgccatgggaggaaaaccactcgccatggtagatgtgttctcaatttcaaatgataccataaaaaagcaggtcatagcgggtatgcatgatgcgtccagacaatttggtgtgccgatcgtcggcgggcacctgcatccggacactccatacagcgtaattgatgttgcaatcctcggtattgccccactggataatattatctacagcaatacagcatgctccggagataacgttcttattgcaatagatttaaaaggcagggttcatccgtcttgtgtattaaactgggacagtgcaaccttgcgaaccgcagaggaggttcgtagtcagatcaggataatggaggagattggatcccgaaaactcgttacagcagggaaggacatatccaatccggggatcattggaacactgggcatgttacttgaagtatctggaaagggagcagatattgatctcacagcagtgccacatcctgacctggatgagtataaaatcacctttgatcactggctccggatgtatccaggaatgggttttgtactaaccgcaaagagggaacatgttggcactattgtcagcctgtttcatcagtgtgatatgaccgtttgtagtattgggaccgtgaatgattcaggggaacttcgtattcacaataataactcctctgcacttgtctttgacttttcgaaaaacggaggggtaatgcatcttggaacatatccctgaaaaatcatcagtcattggcattggtatcagaagtgatcccgaacgggtattttttggtatctcatcctattcaggcaggtcaacgatcaggtgttacctgcatacggatcttcatacatctgtaccaccccggtttcattcaattatttccgaacatccagagctggatctgatatcagatcttttttccgggacacttgatgcagcgattcgggggacattatcctcacatcatacactgcagctattaaaagagacagccggagtatccacacttgaacgagtagtccttttggagactgcagacggctctcatttcttccttggtccggtagggatagatgaaggatggaccatttctgacaaagtatcgcttattgaaaaagtaaaaccactctgtcagaagttcgggctttcggaaaaggtgaccattctgtcaggtggtcgtctggatgatgtcggtcgtcatcctgccgttgacagaagtcttgctgatgcagaactggttgcccgtctgtccggaggggttcacagaggcatactcatcgaagaggcagtaaaggactcaggattcattgtagctcctgatggagtatcgggtaatttaatcttcagaacactgttatttcttgggagaggacgttcttatggggcaccagtcctgaatatcccgaaaatctttgtagatacttcgcgcgttaacccgaactatcttcacgcgctaaatctcgcagataatctcattgagttatctttcctgaaaaaatcttcaatttgaaccggaattttatttctttacaataatgcatccgattggtcaactctgaaacctaatctcatgaaatattaaaatctactcttatcaggtcagaatatcgaaaatctcgagataatctcgaaatatttaaatagatatcaatatactttgttttgaggtagaggactatggcagacttacctattgcagcagttgtaagaattgcaaagaagaatggggctgagcgtgtgggaagcgatgcagcagcagctcttgtagcaaaagctgaagactacattgcaaacctgacaagggaagcaaaccgccttgcccagcatgcaggtagaaaaacaattaaggaagaagacgtcaagatggccgcagagaatgcctaaaagcattctccacctttgacttattccggaaaagaatctccttacctcaaaaaaattatatgtgtgctcggatggggttgatttctttcgttacagcacaccttttgtacttggaacctgtccgtcatcgtagacaatttttgttgctgagtgcagtgcaactccaaatgccttaaagagtgcctcgcatttgtgatgatccgaaaatccggatacattcatatgagccgtcactttcgcgttctgaataaaactttcaaaaaaatgtcgaaccagccaggactcgataactccttctaccggtccgctgaatgaaccctcaaagacaagatacgggcgacccccgacatcaagtgctacctctgcctttgactcatccataggaacgatgacacttgcgaatcgctgaatacctcttccctcaccaagagcgtgtgtgaagacctgccccagaacgataccaatgtcttcaatggtgtgatgaggacccttctcaagatctccgatagcctgaatatccagatcaaatctgctatgtctcgtgaatgaatcaagcatatgatcaaaaaatggaattccggtatgaattgtccccttgccagagccgtcaagtgaaaaacgaaccgtgatatctgtttctttagtctttctctttatttctgcagttctcatcctgctgcctccaacgcctcttgaagtgttatctttccagaataaagagcagacccaaggaccacacctgcagcatcggcttctttcagaatttttatgtccgatggtgaggtaataccacctgccacaacaacaggaacactcacggtgcttaagagatcccgaatcggttttggatctattccattacacaggccctcgacactaacattggtatacagtaatgaaccagctcccttcctgataaacaggtcagcccactcaagaaagtcacctgccggacgttcccatccatgtgtcaccatctctcctgccctggcatcgacccctgccattatccgatcacttccatattcttcagaaagaatggtaagacattccggatcatcagcagcaaatgtggagataatgatacgatcaaccccgcagtcaagccaggaacgggcatcatcaagggatcgaatccctccgccgagttgggttttaacgccagtccggataatgacgtcggttatcttttcagcattcagtttcgaagatccgaacgccccatcaagatttacgatatgaagggcttctgctccctggtttatccatgattctgcgcataaaaggggatcgccatagctggtagcggtctcccgtttcccctgaacgagctgaacacaccggccacccaggatatcaactgccggaaagacaatcattttttcacctgattaagcgctcaatattcattaccagtatatcccgtgcacctgcctgtttcaggcggtttataagctggtagaccttctcctcgtcaaccaccgcatgaacagcaaccatatcggcagaagacgccacatccattatggtgggtccacccattccaggaataatggttcttatatcatcaagggaactgcgtattacattcatcatcagataacatttcccccgggcattcaatacactctcgagtgccagatgaatctcatcaatcttttcttttttatcaatacatgaccggggatttgcgataagataagtacttgtttcaagaacagtatcaataatctttaagtgattctgacgaagagttgatccagaacttgaaatatcaacaatggcatcagatatgccaagagacggagttgcttcacaagctcccccgaccggaacaataatcggtatgataccagcttttttaaaatatttcctggtaattgcaggaaattctgttgatacccgcttcccattcagatctttgggggaattcagatttgaattttccgggactgcaagaacaacagaagctgatccaaatcccaaattgagaagctccgtcactgcggaacctcgttccacaaccatatcatgaccggtaatcccaagatctgcaacaccagaagcgacatattccgggatatctatcggacgggcatagaggatttccacgtgttgatcacgggtccgggcgatcagggtccgatcaccattatcaataatcccaagaccggatttttcaattaattccctgattggaacagatatccgccctttgttcgggatcgcaatacggacatgaaaaacaggagtccgatcagagatcggagaagaatttttggtcattaaaatgtctttaattctcctctgattacccgttctgtaacagaggtgatgttttcaagaccggagtcaatgatctcataaacatctctttcaatatcttttacggtaaatgacggctttggaattatctgtgcacttgctaccagcggctggtcaataggtgaaccaatctgtgagagaagccggacctgaatctctgcaataccatcgactttctctacacaggtgtgtgccagttcattcgaaaggagattatagatcttaccgatatggttaatcgggtttttcccactggttgcttccatgctcatcgggcggtgcggagtgataagaccattggcacggtttcctcttcccacagaaccatcatcacccatttctgcagatgttccggttaccgtcagaaacagactgcactcgatatcgcaatctgcagtattaacagaaacttctacttttttatcagtacaggtttttgctactttcagtgcttcctctgctaatttctcacggtagtttacataatcagagagggatgagacatagcggtcaaccatcgcacaacaaatagtgagtttaatggtgttaccctggcgaagccccatgattttaatatcagttccataaaccgggtatttgggacggagcgtggtatcgatatatgaagagatctcacggatacatttttctatgtcagagaatggagcataagaaactccaaatgatgtatcgtttgcgcgtggaatttgtcctgcttcaggtttaaagacatcccgaagatccgttgacccggtaccaagacgacagtccatgattaaatgctggtcaagattgagttcaggcaggattgtccggaggtagtctttggccgcttttaatgcaacggtatctgcggcaatcttttcaccattgaattccttagtggcacgaccatcaagaagaacaaatataggcttgatgatctttccaccgccaaatttcggcattgattctcctgcaactatctcaccctgatcggtattgtgatgaagaactccgccaaactggtctatataggtattacacaatgcacggctgactgcctctgctattccatctgcaatactatcaggatgaccaagacatttcctctcgaccagttcaatctgttgatcctgaaccgggatctggttcagcatttcaattgtgatatttctgctcatcaaagacctctgtacgatttaaatcagaaagatataccaaggacaggtacagaatactgtacaaattcggtgagattggaataagagattaccgataaatttctccatgaccttcatcaactgaacaaaaatcaatggtccagaatatgaaaaatacacaagacaacacggataatacctgtaaagcgttatgggaatttccacctgttcccccggataattttttctccattataaattccaataacgatggcgcaagacttctctgcctgattggtgcatcggtcagattaggaatatttgataccctggaagactggaaaaatgaacatgatttagaagatataattcaatatccacatccggttactgatttcgttcagagtttaataaaaaccggtcttgttgaatataaggatggaaagatacgaaacacgccggttgcttcaacatatctcaccagtcattctccgtattttcagggagcatatctggaaaagtctattcagcatctacaagacctctggatacctctttctgatattctgacatccggcccgaaaatatttgttgaagaaaagttctttgctgatatatcattgccatcgatggcgcagaatgcgttgtgtggacgacttcaggaagtagtgaatggagtaacatctctctcctcatttatgaatatgaaaaaaatgatagaccttggtgggggacatggtctgtacgcaatcgcacttgcatgtaaaaatcccaacctcagcgcaataatatttgatttacccggagttgttccactggcaaccggatatattgaaaaataccatcttgaaggaagggtcaaggtaatgggagggaattttttctctgatccaattggccgggattatgatcttatcctttcatcatctaaccccagtgggaaaagtcctgacatggtagggaaaatctccgatgctttgaaaaaaggaggattttttgtgagtattcagccaggtgatgagaatgcgccctatgattcacttcatgaacttgaatttttcctctggacatttgacaccgcaactttgccaaagaaaacatggagtaagaataaaaaattcctgacagaggaataccgatctgcgttaaaagataatggacttaccatcagatcagttactagggtttctgatccctatattcaggattatggagtaaccatgatgattgcacaaaaaatggggtgagatgaggtaatcaggatcggatttccaaaatatgagagggtatcatcaactcaaatcgtgcgccttctccgaagactccattttcctgaatggtgatctcaaagattgataaaattttttcagctaaaaataatccatatccactaccctttccaaaaccaagatcaaatattctggttttttgctgctggacaataccacaaccgtcatcctggataataagcttccccccgtcaccgtctggttctagagagatgtgaactgtagtagcaccggttgcgtgttccggaatatttgctaaaattttctcaagggcaagcctgaaatttctgtctgcatacatcagagagttcccggtatctatgaagacctggattggatccatcacaatttcattcagagcttcttttatgatatctgacagggatatccaggagaattcaagcattccgatcttctgatattcacaagtaaagattaaccggtcacgaattttttcagcagcattctgttctttctgggtaaaatctatcaatgtaggatctgttatcaaatcagttgaaagttcaagatatccgagtattgcggtaagttggtttaaaatatcatgccgtatttttgaatttaacgtattccagatttcagaccctttatataataatgcccattctatcggaagagaacttatccataaatagctgagtgctttttgtggccgacctgcattatcataagaaagggaacagtattcctcaacccaccgataatatgccccggcgcggattctgtacctaagctcaatgccaggcctcttctgcagtaaggccccgcccatttttctggaaaccagatcctgatcatccttgtagatattggaaaggatgtcagtctccccatctgttgaattcaccagaatgccatattttaaattattagcagaaatggattttattttccatatatccgaattattacgttcaaacgcaataaccggtgcagcgtgaaaaaggtcatccggggaggttgtaatggtcatcttataaccgctatttctctttcagggtggtaatatactttgacacaggaggcaggcattatcatcatgcctgtagttcagatgctatcgcatcacgaatcggttcccatgagattctgcctactggaattaccttaccctcaattaatatcatggggattgcaggatgatcacgttcatatatctctcttatatagtcaggagctccatcatcaagaagagtaagtttaagagtaacgcactctccaaattcttttaaaactctacttttcaaagcctcaaacgcctttaccagacttcccgaaggagcacaggaagagagaccacaggttctgttctcatcacagggaaaaggggaacattcagaatctgaataaccgacgatctcaagtgttgcagatgctgtcacgggaattaatgtctgcagaataggataagaggatattggttggtagcctaccggagaaagatctcaaaccgttctttttcagccttacaaatggggcacttttcaggcggattattccgagcacaaagatatccgcagactttacagcgataaaccggaaatggaaggcctcctgccggaactgatgatgaagactttttcattcgttcagaagcaagaggtcgcctttccggaaccaccggtgccggaagattctccgaggcaatagtgtctgatacataaaggccgcaaaagcatgctccatactcactgaggtcatcatcacgataatcgcaggggcagataatgtcaagatcagattccttatctccgagagaaagtctgcatggacatgattcgtatccatatctgttggcattgattaaaagtccttcaaccaaccctctggtaaaaaccgtatcgggattaagattatatccgctttttttagcttcctgtataagttcattatgccttttatcaagtaagttctctgaaacatccggtgtcatgacaaaagcgcctctcgtatctcatcaagcctgcttcccacaataaccttgttattattgattaccaaagtcggaaatgatccccgtggatttactttctccatctctttgagtacctcatccatctcgcttcgactgagttgatcaacatacaggtaatcataggctacttttaattcatcaagaagttttctggtctgtttacaatgaatacaggtagaaagggcatacaacattattgatcccttatcaataccctcaacatgaacaggagttatcgccatatatctggtatctgttctctttcgcaataaaagggcaggagatatggtgaagagtgtatcaacctgttacctgaaattatattgacggataaaataccagtgatctgccagctttttcttaagatcagtgaccatcttaattacaatcggaaaggcttcatcagatactgctttctctaatacctcccgatatatttcaggctctcgaatagcagatatatccagaccagccattgctgcaataagaccaaggttcgtgtacgggagacctccttcaacactatatcctccttcaaggacagcaataattctcccataacagatagaatcggcaagaatgcacatctcctgcataagacgagcatacccctgcgcggtcagtgcaagtccggttaggggatcagtgaaatgattatcctgacctgcagaaattgcaatggcatctggcatgtactcatcagccagaggaagaatgatctcctcgagaagataccgatagaccttatctgaactcccagctggaattgggagatttatattgtatcctttgccatcaccaatcccgatatcctcaaatcgtccggacccgggataaaagggatattgatgtactgaacaaaaaaggactgaaggatcatcatagaagatctcttctgttccatttccatgatgtgcatcccagtcaaggaccataatcctcctaaggcccctgcgctgaagataccgaaccattatggcaacattattgagatagcaaaaacctgccccatgtgaacgtcctgcatgatgcccgggcggccgtgacaggacaaaagaattccttacctcctggttcagtactgcatctgcaccggttattgctccccctgctgcgagaagtgcatcatgaatcaatccttttggtacataggtatctgcatctattatagcaccgttgactgaggcttcttcaagaaaatgcagatattccttcgtatggactaagagcacatcatctctcatcgcaggctttggggtcagaagacgtatctgagggagatcaaagattccctcctcttcaagctggtcaagagtgtatgataagcgttcacgtcgttcagggtgtgatgaactctgttcatgagtcagatatgatggagcatacacgataccgcacgtcataatgcctccactgaaattccgggagctatcgcaaggaccatgttagtaatttttgctgtgactctccaacctctcaccacatcatacgaagaaaagtatagtacttcaatatcttcgatatcttcttcaggtgccccttcttttcttgcaatctccctgaccagttcagttgcatacgagagcagatcttcttcatctctggtatctttataagggtaggatatcccgtttaaagtcagccttttccgctccgaatcaacatgtatgtgtacttcaagacttacttttgacactgcagcacccacagcattggcagatgcggcatgctcaggtacaatcccgacagtttgtgcgcgttcagcaatatcagaaagaagataatgagccaggtatccagttccgatgagaacctcaggatgatattcttttacagcagaggcgaccatatccagataccggtgaacaacattctgagcagttgtatggtcaagaacttcagatctctcggcgtcaccaattcttgcccccataacgttcaaagcatccgtcagggtcggttcacctcccccaaacgaacgggaggaacccgccctgaaaggacagaggtctgatcgtatacatgaatcgccaccaaaggggatactcatagctgatactgctttaatcatcgtcttggcaccttccaaaacaaccgtctcgaggataggttttccatcctttaatgggaccagttcagttgttgttcccccgatatctatcaccagacagttctcatttttggtcaggtaatatgctccgtttgcgacagttgcaggacttgaatgaaaaagcagcatcgggttatcaagagcacgggcaggtgaggtcagccctccggtcgatgtgacaaaaaagaaatccggatttaccctctgaatctgcctgatgagagatgcgactttcccctttatcctggcattcaattttgtagtatgaattcgtgcgggaaaatttaacgcccctatgggataactaagggctatctgttcatcagaataaaactgtgatacaatatcatatacttgtttttccaatgcatcattccggacagaaaatttgccggcaatcgctatagcccgtgcatgctgacccttcatgattttttttatctcttcaggatcaattggttcaacaatatctccgcgatgtgaaaccgatccttttaccgcaccaggatataccaggcctggtcccggtatagttattgtccggatatctgcggtatgaccggtgataatctcattcaatggctgagaagtgctgatagcaaggcgcccgtatgaggaaattttttgaagggcattgtcaagcccgtcagtatttggtactttataggtattgatttgagaatctatgacagcaatatcagtatttgtccctccgatatctatcccggtaaacatgattgctcacggggttttagattcccaacatatatcagatgatgcatatacacttcagataaattttcgaaaaccaagggcaattctcatgaacaccggctgtctgaaaggagaaacattactaaaaaaaggagttgccgcagtcttttttaatccgaaaacacggttcataacaaaattttacgtgaccaactatcggctaattataaaaaaccagaaaaatcaggttataaaattatcctatgaactcattcatgagatatatgttgaaaataacacctacgtatgcatcaggtgtaatactcccatgaggttttttgatggaaaggaggagtatgtcagaattttcatgcatgggctaaagcgcaaagaagggggcggtttgaaggtacttgatgatccgaaatggccgaattattggaaaaaatttattaatacacaggttttgcagtatcaatcagaaattgcctctaaaaagcaatccatgcagacagaagaagatgaactccttcttattgaaggtgttactaggtctaaagaagggcttgatcagtttgagattgtgaaaaccagggagaagatgcaggtcaggtttgataatttttattatgaatcctgcatggtatatgcaacaaataaccgacttgtcgtgaaaataaaatctggggattatatcataattccctattctgttatttatacatcagagcaggatccaggtggtgaaatttctattacgttctctttccctcaggatgttgaaggatttgagagtgaaatttcgaagatgtttattaagcgcatccctaaagcaggagaggaatatccggaaaaactgcaggaacggtggaatgaagagtggagtgaattcttccggaaagtgacatctcaattcagagaacataaaggggcagtcagtcctgatgaaatgcttgagatgctaattgaaatgaagcacagtccgacaaaatataatctctcctcatatgcaaagcagggatgggatcgtgcatgcggtctggcagtagaacgattcggatatgacaactcagatctttttttattcatgaattttcttctgcatgagtatgaagagatgaagacccgttctatggcagaacctgacccggcaaggcaggaggcatatcgggggtcagaaatggcctacagcgctatactttcctacatcaaccatcacaccaaagtcaggtaacagtgaagataaatactcttcaggatattctggttatggatcctgaacaggatgccatgatgatcattgcatcacttatggcagtctctgcacggacagcaccaaaaggaaagggtgttgacactattgtaacccggattgttaccggaaatgatatggatcgtattgcggatgagatgatcgcaatcggaaataaaactggtttgcctccatttccccgtgacgcacaaaacatacgggatagtaaagtatgcgttcttatcgggtgtaagggggcagaggaccttggacttaattgtggtgggtgtggatatcagacctgtaaggagatgcgcgagaaggcatcccaaaatccagtccggtcactctttaccggcccgaattgtgtgatcagaatggccgatctcggtatcgcagttggatctgcagcgaaaacagcacaaattcataatgcagacaaccgaattctcttcactgccggagttgctgcattatctcttcacctgcttcctgactgtacctgcgcttatgggatcccgctctcagttaccgggaagaatattttctttgataggaggccggttacatgacaatcctgaagatcagggggggagatctggacctggttgagtatgactttacgtcatttcatcctggcgagaatatgaatacctgtggttttgaaaaatcctattcactctcgcctgtaaaaactcctgtcaggacacaggcacctggcaggatacatctgacagttctggatatgaaccggtttgcacccggacatccgggaggcgggggtattgggtttgctattgacgtttttgctgaagtggaagtcaggtgtattgagaaaggatttgagatcaattattccaggcctgcgataatcaaacatttcctgctagtattttcaaaaactgttggatatacgggaggattttcagttactgcgaaagaccatgactataaacatgtaggacttggctccacgagtactatactcaccgcgttatcagctgcagtaaacagggctcttggagatccattaacccttgatcaacttagaatactcatcggtaacaattatgttgaagagacagaagggggaatgattgcctacgggtttgagaccggggtaggtcctgcagtgagtggcagaggaggaatggctatccttggtgataatctgacggttgttcatcagcatatttttgctaaaggaaaaaatgtccacatagtaatccccccaagttcaatctcatcagcaggagaagaggaattttccctgctcatgaacaaggcacgttcacttgattaccgggaccgtgaactgaaagcatatatcgttatgatggacttcattcccgcactcaatcaggatgatctgaaaaaaatgggcgactctatgtgggagatggagttcagaggatcaaaaagagctgaaattgagcatcactcctttgaattatatcagtatatgcataaactcagaaaagccggactagaatttatcggtatgagttcggtcgggccatcaatagcagtaatcactgatatgtcacgtgaaaaactctcatccatacttactcctttgcaacttgaaattgccgtcagtacaaaagtgaataactcaggtcttgtttttctctaaagaaaaccaatcaaatatagaattttttaccttccggtgacgtgtattcatggatattaaacctctcggctgctatatatcaggagggcttatctggttttctcctgttataaaccgggtattacgcctgacgataccatttttattgactggtgttctgataggagtacttttctggctttatgatgacacgaccgctcttcagctgggtggtctgttattattgtattttgttcctccggcaggcaaagagagtattattcctgcaggtatcgcccttggatttccgtttcagatcatgtgtctgtcaatattctgggtagatatcgcctgttgtctgtttatgatatggaattttgaactgatttgtaatgttccataccttggaaatataatccggtatcttataagaaaaggggaattatatcttggtaaacaccgatggcttgagcagctttattttattggtctgattttttttgttttctttccattgcagggcaccggctctgtgagtggttcagttattggtaagatgattggacttaaatcaattgaaattttcgctgcaatagcaataggttcgtttttatcgagctttcttatcggctattcagtatatgccctgcatgaatatctggatgtgaatgtctggtatgttcttatagcggtgatgtttattattatcatcttaccacttttatcatatggattttataaaacaaaaacaggcagtaaagtatgttcttggatctccggatgtgttcataaatgcagacaatcttttaataaataatataaataccactttgatacctgatctgaatccttttttactggtaatgagagccgggttcatatcgcaccctttaacttgtctcgggtaaaccttggatctgacaaaccctttacgtaggagtttttttctgatgcatgaatatggaattgcctatgatatcgttgtcacatcgagaaaagctgcccttgataacaatgcaacgtcgataacccacatctatgtggatgtcggagagctttcaataatcaatcctgatcaggtggagtttctgtttactaccattgtggaagatgatcccctgtttaaagatgcaaaactgacatgtacaaaagttaaaccacagactcgttgttcatgcggatatattgggagtgaaatttttgtctgcccggaatgtggtcaactcccggagattgaaaaaggaaaagaagtggtagttacacgaatcgaagtcgaggctgattaaatgaaaatatcattaatgcatggagcaggtggagaggttatgggtgaagttgttgacctcttctctaaaattaccaatactaatgccggagggataggtcttgaagcgcttgacgatggagcagtcattcccattggagataggcaggtagtcttcaccaccgattcgcatgtagtaaggcccctctttttcccaggtggcgatatcgggcggatttcagtctgcgggacgataaatgatatcgcaatgatgggtgggagacctctcgcactttcctgtggactcataatcgaagagggatttgattttgatacattgtccaaaattgtagactccatggatagagccctttcagaggaaaatgtatcactcgttaccggtgacaccaaggtaatggaaaagggggcattggatcagattgcaataaatactgctggaataggtgttgcggagactatcgtcagagacaatggactcatacctggtgatgccatcattgtatcaggaacactcggggatcatggatttgctgttcttgcaagcagagaagagtttgattttgcagatcagataatttcagatgttgctcctctatcaggaatggtccatgctgccatgaacgcgggaaccattcatgccatgaaagatccgactcggggcggatttgcaagtgccatcaatgaaatggcgaaaaaatcaaaggtcatgatccgcatatccgaagaggaagttccgatccgatcatcagtacgagctgcatcacagttacttggaatcgatccgcttgaagtggcaaatgaaggaaaagtagtcatgggagttccggcagatgatgcagaaactattctgaaagtattgaagggacacagatatggaaaagatgcagcaattatcggaactgttcaggaaggaaccggagtaattatggaaacggcagccgggggcgagcggtttatagagacacccatgggtgatccggttccgcgtgtctgctaaaaatttattttctttttataaaaacacccattccgataaccagactgataagaaccagaacaaccggtactggtgtctcctctcctttctgttcattgcttccatatcgggggggcattccaaaagcctttgcagagacatcagatagtgatattgtctctgctgtatctgcggtaatggtcactttttctgctgctttaaaactgtacggatagactttcaaataaatttctgatactgaatctgaaattgtaaccatttcaggtgatgtccccatctcttcattcactttaacactggcaccatcctgggatgttttatattcaaaaaccatatcagtatttcccgatacctggattgtaatcggtgttttattggttgaaataataaaaagtcccggattgtcccgtgagacctctgcttgtgcagaaatacctgaaatcttttcaactttgacaggggacggagttgctgttggtttcaccgtctcttttatatctgtttctatagctgatgcaacaggtatttcatgggtttctattggaccagtgagatgatattgatctttctcttctgaaactattgagtatttaccgataaaaccatcataatctgtgaatgatacttcatatgtcccaggttctgaaatcgggagttcatattttaccctgcctcccgtaaccggaatagattcaggaccaaagatcgtcttatgatccttcgccacttccatctgaatagcattttccttgtatcctgatatttttgcttcgatgttaagtattttttcaaactcctgccaggtaggtgacgtaaaggttatcagatctgaccgatcgattaattttacaactctgattgaacgtgaaccggcggagaaatccctctgtgactgagatagaccttctaccttataatttcctttctcaagaccatcagttttaaatgtcacgttaaatgtagtttcgcctttctcggtaatctgaattgattgcctctcaatctctatgggaacatttaatgaatgggaaaaaataatgtcaattttatcaggagggggagtattcgttgatccggttacaagaatgggttctcctaccttaacctgggcaggtgcatcaatggacagataatatgcactgactggcccacatatcaggatgaggaggaccagtgtaattgctgtatgaacataacgaagattcatatgttgccctcttgtcggcttggtcaatatgatggaactctcgaacctaatatattgttggtcgggtaatgaatacccatctgtttcctcaccggtgattatgatttgaggaatagtatgataattattccttattagaaatgaaaaaccctggtgaggcagcaacgttcagacttcatagacttaggataattatgaaacctatcaaaaaccctgaagaaccattggcaatctggtcaggtcaggactatattgcaggagaaattcatcccagcgtgactgcaatcattcgttccggaggatgttcgtggaataggtgtaaaatatgtcaataccgtcatgaacgattctctggcatcaaaggagatgaacttacccggctgatgtatgcacagatacaacgcctgaaagagcagattgaaaagataaatccgcatgttgtgaaggtgtatacctcaggaagtttctttgatcctctggaggtcccgaaagagattcaggatcatctcatcgaactggtcaaagggaaaacgctgattgttgagtcgcgatgtgaatacattgacgccgaacagatctcccggtatgtttctcatataaaggaaggaggagaagcgggaaatatttatgtcgccataggtcttgaaacaacttcggataaaatcagggagaaatgtattgacaaaggcctgcagtattcagactacctcaaaacttcagaagtaattcataaagccggtggaaaagtgaagacctatctccttcataaaccaccgtacctgacagaacgagaagcatatgatgacatgattacatcaatccagaatattatgccatccactgacctcatctccatgaatccctgtacagtgcaaagaaacacacaccttgaaacattgtggaagcgacaggcctaccgcccaccttatctctggagtgttgcatcaatccttgccaaatcaccagcacacgtgacctgtgatcccatcggtggaggacaggcgagaggaccgcataactgtggatcatgcgatgggatgatactggacgcaataaaggattataatctgaacgcagatcaggagcttatgctatcagttatggagatggattgcacctgcaaaaacgaatgggaatatgtaatgagtcaggaacgctcctggtccatgcctcttaccagataacttattttttctgtatctgatggagttgatcaaggagcatggggaaaaaagctcctgcatcacttacaacgccgatcgcctgagaggtaccccgatccatcaatttggtaagtgttgacggatttatatcaacacaaacggtcataacatatgatgggagacagttcccgactgctatcgaatgcagcatcgttgcaatcatgaggaccatcccgatttcagggacatatcgtctcatctcatcctgggcaaccatcgcgtcggtgatgacatcaggaaggggtccgtcatcccgaatagagccggcaaggacatagggaacattcctttttatgcattcgtacatgattcctgatcccaaaatccctgtttctaccgcttttctgatcgaaccagctcgcatgatttcactaatagcatagagatgatttttgtgcccggcagaaaccagttcacctgaccggatattcataccaagcgaagtaccgaataaattatactcaatatcatgagtggcaagggcatttcccgcaaagagaatgtcaatatacccttctctgaacatggatgcacaggcttcgtcagcgccggtatgaataattgcaggccctcctaccagagctacctttaacccttttttatgggtgtcgataatttcccgggcaattttccggatagttgtctctgtcggacgttctgaagagataactccgcccatgaattcaaactcctcatgagaacgggaacgctccgggggttttatcttcacaccatgctcaccgatgacaacgagatcccctttctgaagtttcgacattggtgtggctttggctgattttttatcaggtgagacaactatcagacaatccatctcaatattttcaacatgaatccactcattgccgatacgaatctgcgtcgggtaatttgttgttgaataaaagcccttgggaacgatccggttcccttcagctggaaccaaagtgacatcttctgtgtctaccagccgtgccccatgccggtgaagggtgctgatgatagcgtccagatttccgttatctgttccggtaataagcactctggcatagctggtatctgtttttctttttccgacagaaaattccaggatctcaaagtccccgcccatatcaaggatggagtcaagaacatgttccatgatcccagaatcaattatatgcccgtcgagttcgatctcccgggaatcagtcatacctgagacgttagatcgtagccctataagagagttggttgaacgtcagaagatttcatacgcttaagcattatctctgctgtcttcaaatcctccggcgtattgatgttcagtgtcaggagaggatctggaataattatctggatttcatcctgttctctatcgatcatgctcccagtaaggatgttcataccaacaggtatacccggaaacgtatcagaactggtcttctttggatcaggagcccatactgagcaagccggacggccagattcatgaaattgttcaataatcttacgtatatgatcggcagtaatacccggaaggtctgcacatatggtcagaaagggcccggagatagataattcaccaactgcctggcatatgtcctgcacatatcctttcccgtctgtacatatccacggaatgtcatgcattctgcaataatttgtagtatatggagtcaagggggagacaataaccactggttccagctctgccatttctaccgcattcagaacgaatgacaacagaggtttatcatgaattctggtcagggctttttcacccattccaagccgggatgctctgccacctgccattatgagtgcaaacatgcagaaatcttctccagtacctcaataaagcggtcattttcttctttcgtccggatagcaatccgaatacttgtcgagagaccaaaagagctgcagtcgcggaccagtatatcgtttttaaaaaagagatcggtgatatacccagatggccggtcagtctctatgagaagataattggcacttgcttttgaacaggaccatccaactgtggtgatggtctccatcagccgggttttctcttcttctatcatctttcgtgagtattccagatcgtgatatttagaaaatgcagagagaactactttttcagcaaaggcattgaccgtccagggggggcgcataacctccatggatgcaataagatccggatcaccgattccatatccgaatctgattccggggattgcaaaacttttcgttaatgatcggagaacaaataaacgaggatctctgatatctgatacagactgggatggatctgataggtcgatgaatgcttcatcgatgcatagtatctgatcagatcttatccaagaaaaccgggatattatctcctgctttggcaggagaactccagtgggattgtccgggttgcagatgaatgaaagagtggattctttttcagtttttgctttttgtgccccggtgagtcgtgcagacaattcatattcagcaaacgtatgatcaggaacaaaataggtccgattctgatctagaacggtgtggcataatgttctgattacctcaaccgaaccatttcctacggtgatgtgttcaggtttacatccatgatgacgggcaattacctcttttaataccaagtactcatcatcagggtaccgggtcaatgcgtcttcaggtatggaaagatctaattttggagggtatggattaatattggcgctgaaatcaagaatttctctttcatttcctgcaatatattttgctctgcccccatgaacagcacgaagttcagatttgtatctcatctgacagctctttcctattcatgtacacctgattgtttacagctatctattttcactcaggaataaatcgaaacctttatatatttatggattgtattctgtgtatctcgttgtgtctgacttttgtcacctttatgtcagacgtgtgacagacatatgaccgacagatgtcagatcatgaggctagtgtatgaagcgaatcaccatccggttgcctgaacagcagataacgctgctggagaagatggttgaggcgggtgaatttcccaccgtctccgaggctatcagggatgctgtacgtatgctcatcgaaaagcgggcgaccagagtgctcgctgacagtgatcaactgtcattttagacgtgagggggataaaagtatgcagagtatcatcaatgccgcagtcatcaacgcggaacgagaaaaagaactcaagaatatatcgcagaactatgatgatgatatagatggacaaccacgaatcgtcatcattggatgcggtggtgccggaaataataccataaatcgtcttcatcatatgggggtctccggcgcagagacgattgccattaacactgacaaacaacatctggatatgatccaggccgacaagcgtatcctcatcggaaagagcctgacaaaaggacttggagcaggaggttatcctgagatcggcagaaaagctgcagaaatggctcgtccaacattagaaagtcttcttgagtctgttgatctctgttttatcactgcaggtatgggagggggtactggaacaggatctgctccggcagtcgcgcagatagcaaaggaacagggagccattgttgtcggtatggtttcctatccgtttgatgtcgagaaggccagattgattcgggctgaagacggacttgaggccatgtcaaaggcatgtgattcggtcattctccttgacaataaccggctgaagagttttgttccaaaccttccgcttgcacagtctttctcagtcatggaccagttgatcggtgagacagtaaaaggaattaccgaaacgattactgaaccatcacttattaacatcgattatgctgatgtcagagcaatcatgagtaagggtggcgtcgcaaccatgcttgtcggagagtcaaaacaacagaataaagcagaatctgttgttcgagaatgtctctccaacccgatgcttgatatcgattaccgcggcgcaaccggggcattgatccacatcaccggcgggagtgatctgacgcttatagagtccgaagagatcgcttcctctctgacctatgaacttgatcctcatgccgatgttatctggggagcccgtatccgctcagatatggaaggaaaagtacgtgttcttgccatcatgaccggcgtgaaaaatggcgacactatcgccaaaccaaaacagccctacaaggaaaaactcgacagaatagaagaacagatccgttatccgaaatcccctgaccttgcgcgaataaaaccccgctcagtcaccgcagcaatggattacgcaagcggacctgacatcatgtggatgtaaaacacactttaaaacaactgccatagacctcaatattgaaatttctctttttattttctttttttaaaaaacaattaaatttatggtttttcaggtccagaacctatttgtacataagaagatgtctattccatctatcagaataggaaatatcaggagacattaattataaaaatgatgttgtcttcttaatagtagaaggtcacacaggatcccttcgcgattttatgaacgatgggtctcttgtttcggagccttttggtattgggagtcgaacatacgtggatcgtgtagcgaacaagaactgtagtcgaacagatgaatgttataccactcatttcgggtggcaggcattcctgacgggaatcctgaagcgttatctatctctgattctgcccgttttcacacgtccttttgtacatactacgtattgctcttacgtatgtcccatctctcgcaccggtaggggataccagacgtgccttttaatgcgaggattggttaacgatgttgaatgaactgattgataaaagaaaagttactatctcgggatctgaagatcacaagacaaaaagaaatgagtacaatgctcaggccagccagtatgccagagagcggaatactctgaacaatcagacccgtgaatgtgttgaagaagcacaaaagcacaaggaactccgggatcagttcaataaggaagttcaggaacttaaggataagagaaacgagctcaatgaacaggcaaatgtcctctttggagagatcgatgctttcaaaaaggaacatggcggtataaaaagccggagtatcaaagaacttcacaagcagattgaacaccttgagttcagacaacaaaccgaagtgttcacgactgaaaaagaacgtgaactcattgaaaagatcaaagccctgaaggaacagcttcgtgagcaggaagctgaaatcgaacagaataaagagatcagggaaaagataacgcttgcaaaggagctccgtcgtcaggcatctgagatccatgaccatgttactcagctggcagaagatgcccagaaacaccatgacctcatggtagagtgttaccggaaggcagatttatcccgtgaaaaggctgatgaagcacataagaaatttgtcgaggcacaggaagctgccgacaatgaacacaaactcttcatcgcctgccagaaggaactccgcgattatgacaaggttattggcggacttcgaaagaagaacaaaaaggtcaagaccacaaaagagcagaaagaagtcagaaaggaagcagaacaaatcttttcacagtttaaggcaggagaaaagctcaccacagaagacctgcttcttcttcagcgttcaagacttttataatccctttttttcgtttttgcaaagaagtcatttatagagatgcaaccaatatcttggtaatgggtttcatcagaacattagtcctcaatatcgaccgcgatgatgatattgggtttaaagcttccgttgaaagtccggtaataggcagagaggcctgccttgatgccgctatacgccttgccctttcagaccctgaggattcagatctgaacgcaatattccaggcaatctccacgtatgacaaactcattgctgatggagaggaagcagaagttgcggttatcgggggaaaccatttcaggtttattgaaggtgaccgcaagatagcccggttacttgatgatgtgatttcgcagaccggatgtaatcaatgcattcttgtcaccgacgggggtgaagacgaatatatacttcccatcattcagggaaaaatttcagtcacatcaatacagcgggtggtagtttcgcagatgccaaaccttgaaggcacatattatatcattaaaaaacttatcagcgatccaaaaatatcaaaaattgttctggtgctcccaggacttacgctcctcctttatgcaatcagctatgcagtaaacagaccggagatcgcaactatagtaattgccgggtgtgtcggggggtatttactctataaaggattttcattggatgaggttgtcagaagcgaagtaattgatcttagatccacactctaccgtgggagattttcctttgttacctatatcggggggttaatttttgcgatcataggagtgatggaagggacatcagcacttaccaattactgggacgggagtggaatattcccgatggccatcatctttttatggggagcagtcgcctggtttacccttgcagcaataactacctcacttggatcaattattgacagtttcctctatgaacgagagagtctctcacgcgcagtaattttttcctatttcataagtgcaatcggagtacttgcctttggagggatgagttataccctttcaaacctgaatctctctcaatttccaataacacaggatcttggtataacatacataattcaaggtgcaattggcggacttgtctgtgcattcgtcggaatcattctccagcattttatatccatgtgggcaatgaatgaaaatgagactatttcacaggcataatcattttcatttaaaatattccggtcagtagctcaagagacatctataaattctcatccgtctcttttgaccatatcagatctcatggagggctgattatggggaatataaataattgtcttaaaattcttattctctttcttgtcgtaaccggactcttctgcgtgcaggtatctgctattacagctgatgcccggataggaccactcaagggaactgcaccattgaatgttatgtttaccgatgcatcagtaggaaaaccaattgaatggcattgggattttggtgacggatataccggtgacggaccacggaccatgcatacctacatgactccaggtacatataccgtgaccctccttgtcctggatgcacagggaggatcagacactgctacatttaatcaggcaatttcggttactgccaatccgttcatgccggttatgccaatgagtctcccttccttctctgctgattttaccggaggccctcaatcaggaccggcaccacttgcagtctcttttgcagacctctcgaaaggtgagccaaagacctgggtatgggatttcggagatggtacaacatctattgatcaaaatccagttcatatttactcaacaccgggaacatacactgtcacattaaaaattgcaaaggattcaagcacaggaatgaaggaaaggaaaaattacatatctgtgactccggggacaggcattcctgatcagcaggttgtaagttcctcatcagcatcttcctcaacggagggggagccaggacaaagtatgagtacaccagaaaatgcaccatctgaatatgcattcatggtggaaccgacaccagaggagggatattcctgtcagtcagatctatctctggttactgaatcagagaccatcaggtctggtgaggactttatgatcaccgtcaatggtaatcctctggaaaaagtatacttctggatatccatgaaagaagggaatacttcagaagaaatgaatcctcctgtcattttggataatgaaatggtctttgataaaccagagggtcctttctcgattggtcaatatgttcctgataaaaatacaggagcctcaataactgagttaattgtcgataatgaatctgcttatgcaacaggactatacggactggtggcacttgataaaaatggtgaacatgtcattatgatccaggcaaaagagacatctccaggagtatatatcgcaaatgcgattactggagagcctggaaaagagggaggatgtatatctcaattgcaggtaaagatcctgccataatacattttaagctggcacaataatattcatgacttgcacactcaagaggtgattttctatgaaaaaaatacgatttattcaaatccttggagtaattttctgtattcttcttattactgtcggattttgtgctgcattctccatgtcatcaggagtctcttccacaagttcatcaggtgggttttcatcaagcagtagttcaagtaatcttgggtttagtacatctactcttgtaatgacaggaggaacgccctcaaaaccggcaacatctcctactcctgccggagggcctggtactatcccaccgaatgaggtaatccctccacaatggcagccgggaactcgatctggaacattttttgatcccgtaacacagaccagctggttctttgacaatgtccttcagaaattttatacaccgacgtatgggtggtttttagtcacccaatttacgaaagaaggaaaagtgtatgcccaattttattatgatccaaaatcaggcgtcttcagggagatgaaatccggagcaactatcatgagcacggctggtacatctcagccctcaggttcaaccgggcagcaaggtcagcaggcgggcccgtcgcagccttcagggcagacaccttctccatataccggtgcttctccaattgttgcagcaactactccttcatcaggtaccccttcatctaacacccatccatgcagaattgtatgtacctcctgtacttcaggattctgtgatgattgtaatcagaatggagtatgcgatgatacagaatcatcaggaaaacccgttattaccgcatctaaacctcaaacacagactggtggagtgagtgaggagccacaacagcctatccagataaatctgccagttaccccaggggtgacaccaggaatatcggctgagggtggtctgagtgaagatccgcaatcgactatttattatatggttgctcttccgttaagtggcgttcgcccgattgtggcctgtgacccattccaggaatgtgaatattgtcttgatattgatgatgatggcgcatgcacacttctggattatgcaatcatccaatgcaaagagaaatgggggcttgattacatgggaagcagagataatatctgtgatacagatattctgttaatcatggattgctctgaaccatccggatgtacagtagcagaattctgcagagatgcagatggtgatggtttctgtgatgaagaatcagaacctgaagacctactataaaatctctttttgcaactctcttctcaaaacatcacaaactcattttcacgagtatttattaccacgtacatgaatgatgaatacatggatatgatggctcggtttatatcagtaaacagagataaaacatacacaattcggttcacggtatttttaaaattgtttttcgttttttgtatagggctcatgattattgaaccagtgtttggtgctggtcaggcacacaccataggagatgtaattctcaagaccgatcaattgagaaatctaaccggagcagatgggtcaggtattggaataggaattatttcaaatggtgcagcaggactcatacaggcccaggaatctggagaccttcctcaaaatgtcatagttctcatgaatgggcggggaagcgaaggaacagcgatgatggagatcattcatgatattgcccctggtgcacctctattatatcatgattttggtggaggggcgcaaaatgactttatctatgctatagaatccctcatagatgcgggtgccaggataattgttgatgatgtcggatttttgcaggtaccatattttgaggatggatatactgcacagaatttaaaccggatacttgatgagcaccctgaagtgattctcgtgagtgctgcaggtaataatgcagaaattcattaccaggcaaaattttctgatgatgggtctgggtatcactcatttgacgggatgaggggcattcctatcgccattcagccgggagggatgttttccgcatttttacaatgggacgatatgtatggtaattctgcaaacgattataatctctatcttgaagagaatggggaactgattgcactcagtgaacgaattcaggatgggagcactcttccggaagaaaaatttacctatatcaatgatgggaaaagccttgttcaggctgagctcaggataaaaaaagaaaacccttctgttgaagataaaaatatagaacttttcataaacgcccagaaagataaagtatacatcaccagacaacatctggttatcgaggattccattatcggacaggcagcggttccaagagtattatcagtagctgcgatatcacctgaaaaagtcaattcaattgagcgatattcttcccagggatttgtaaccatttcatatccggagagtacggtcagacaaaaaccggacattaccggaatcaataatgttgctgtttccggtgcagggggattccctaaaaaattcccaggaacgagtgctgcagcacctcatattgcaggacttcttgctcttgaatggagtctgtttccttccataccggcagatgatatgagaaatgctctgctctcaacagcccttgaacttggtgaacctggctgggatccggctttcggatatggtctgcctgatgccatcaaaatgtatgaaaaattacagggattaaaaccagataatcctcttgattcatcattggctcaaaaaccggttaaatccatacaatccaagatggaacccccggttatgctctccggatcaggagagataacaggacccgtcattatcacttcaccaggaacgtatacacttgggaaggatatcgtgcactctgccggttcaatcataacgattatgtcttctgatgttaccatccagggtgggggaaaaagaattgagggattaagtgtccagttcatcgataataccccgatagatcagaatgccatcctcatccagtccccggattcaggaaaactgaaaaatgtagttatcagagatatggtgattgaggggacgacgaatgccatcattggaaaaaaactggagaaacttcatattgatggatgtaccctgtcacacaacgctattggtattggtctgtatggatcagataatggactcatcgagaactgcctgctctccggcaactcatataagggacttgctatcaaagatggttcttctgacaatctggtaaaaggaaacacaattgagaaaaacctctacgggattgatacaatcggcagcgtgaacaccattcttgaagacaatattatccgtgataaccgtagagaggatatttatacgccaaaagagcaggcacctgatatcattcccacagtaacccccaccgggatcgtcccctgtccagatgcaaattatgatggaatttgtgatgatccaaatggaactccccagcctacaaaagcaccgacaacttcctctgttccattttcatattcagaggaaatttcaatgacaaccatctatacttacccgactccacacccaactagctgttggcattgctaaatctcttaaatttaatttttaatttttatcagaagaaaaatagagagcaatcctccaaaccttcattaccacagcgtctcatataacaggatcacgatgtggtgtaaatgaaaataataaatatctttttagttatgattgcaattgtttgcttaattggaacaataaaccagatacaggcagaagaaacgggtcccaaactaatgaagaccactccttcaggcacgaatgtccctttccaggattcagttttttctctctccaacattgttccaccaatcaaatattcgatggaaataacatttcaaaaatttctgacagacagaaaagctgtcgttattccagttccaatttccttcggtccatttggagtaaacagggtagaaattatcgttcctaaccattggaaaaaggggatcagagtagggactttttatgatcaactactgggcatcacctggatttatgaccgaaatctacaaacctgcttttctccagaaaagggatgggttctggtgacggagtattcaacggagaggatacctctcgcgcaatactattttgatctggataataggatcctttttgatatgtataccgggctgccgctgaccggagggcctcctcttagtactcctcaatctgcagagacacccatgcaggttgctacagaaccagaaatcagcaatttgtcagatgagagtaccactggagcatttccccagaccgatcaatgtattactcaatgctctacctgttcttcgggattttgtcatgattgtaatggcaatggtatttgtgacgaaaacgaagaaataacacttatatcacaaccaacacagactcagacccttcccacacccatgataacacaggaaccagttcaaacacctgcttatacgccaaaacctactcaaagttcacaagtcattaccggtcagacacaagttcctgtgcagactccctttgtgacaatcacaaaaacaccaaccataacaccaactcaaacccttctgccgataagtgaacaaccacaggtacctatacaaccaacgcaaccaccgcaaccaggtccgacagaatcaggaatcagtgagcagccgcaatctcctattcaaatcagtcttattccggatattttcgatgaggacgcatcagaaaagccagatgaaagtgatagtttcagcgaaactcctcagagtacgatcctctattatcagttaccaaaaggaaaagggccgtttaaagtcattgattgtcttcctggtgaggattgcgtatattgcattgatgaaaatgaaaatcagatctgtgacatatcagaatgttatctcattatctgcaataatccggatgaatgtaattattgcattgactgcgatcgtaatctggtgtgtgatctggataagatgattatcaggaattgctatccagatgagcaatgtgaagagatagattactgtgttgacaaaaaccagaatttcagatgtgattcggatgagagtattgaagaggaagaggaaaattttgataattatccacttatatcagactggggttcaataacctggtattaacgtatcatttatttttcaacgatgcagataaactctcaaatagtacagcttagaacaataatttctttaggaacggtggactatgacaaaaaatgtgaaaaaaaaatctaataataacaaaatttttgcaggtattttttttgttttattcttttctctcttatgcaacttggtaacagctgctggatcggcccatacagaaggcgattatgtattgaaaacggatcaactgagaaatctgacgaatgctgatggagctggagtaattgtcggtgtagtatcgagtggagtaaaaggtttagcagatgctcaaagatcaggtgacttacccgatagcctcgtaatattaaaagaaggcaaaaaagctgaaggaactgcaatgatggagattatccacgatattgctcccggagccactcttctctatcatgattttggaggagggagagaagagaaatttattgaagcttttcaaaacctcataaatgccggcgcaacaatcattgtagaagatgtgtttaattatgaagtcccgtattttgaagatggaacaatagcacaggaaatatccaaaattatagatgaaaatcctgatctcctgattattagttcagctgggaatactgccaataaccattatcaggcagttttctctgatggtggtgaaggatatcattcatttaatggctccaccggaattcctcttgaaattcagcctggtgggagagtgaaactccatttacaatgggatgatccctatacggcagcatcaaatgactttgatctcttcattcatgatctgcagagcgactcagatgttgctatcggaaataaggtgcagaccggagaagagaaaccctacgaaaaaatcgattatcagaatgttggagataaagttcaaaaagccgaggttcggatccgggcaaaagaaggcaaaggacagggatcacaccttgaactcttactcgaaactgatgctacacgagttgtagtcggaaaagaatatctgactcctaatgattcaatcatcggttgggcggctcttcccaatgtgatttcagttgctgccctttccgcagaaaatcagaaaattcaggatttttcatctcagggtactgtcacaattgcctatccggtccctgatgtcagggaaaaaccagaaattacaggtgttgacggagtcagtgttacaggggctggtgattttccaacaccattcacaggcacaagcgctgctgcaccgcacattgcaggattgcttgcattagtaaaaagtctgtatccgacagtcccaaatactgaactgcgtgatgcactcctgaatagtgccaccgatttgggaacccccggatgggatgccatttatggatatggccttgctgatgctctctcacttcatgcctatcttcaggaagcaggaaggacccctgaagtaccaggcacaaatcagacaccagtaattcctgatatcattataccttctgaacaacttcctccaaacgaatttatcctcactgaaccggccgttctctcaaaacccggatcatatatcctgggtgatgacatcatcgacttttctgaaaccattctgacaattaccggttcagatattaatattgatggaaatggtcactcaatatcaggcatatcaatccggtttggaaccgaagctccggtcttacaaacagggatactcatttggtctcctgaaaacaaaccggtttcaaatatttcaatcagaaatctgaatgttaccggaacatatgcaggaatttcagcgaaaggagttcaaaaccttcttattgactcatgtggtctactctataataacagagggattgatctttcaaataccaggaatatccggatacaaaaatctgtcaccataggaaatggatatgccggaattcatgcagatgccagttctactgatctatctattgaagataaccagattactaagaatctatatggtatcgtactggatggttcatccctttccatggtgaacaaaaatctggtaactgataattattatgatggcattaaactggatcatggcgtgaatcttgttcaggttgataataatttctgtgcaggaaataagaatggaggaatcaccctattatccggacataaaaacgctatcacaaataatacctgtcagatgaataatccgtctggcattttgctttcagaatgttctgaaaacactatttccggaaaccgtctggtacgaaatgtcagaggattgaatgcatactattcagacaataatattataacctataatgaaatcgtcggaaatgatgcaacgggcatcatgctccaaccttcaggccataacagcatttcagataaccggattattgcgaattttgcagaagggattctgattaccaatgcagtgggttcagatcagatcaaccggattgtaaacaactatcttgaaaacttccagaatgttcgcatccaggagggaggaagacccaattatcaatggaatgatcctatgacaacagcgacgaacattatcggaggtccggtaaaaggcggtaatgtctggtctctaccagatgggaaaggatattcccagacttgtcaggacaaaaatgcggatggtatatgcgatcttccctttacggtcttttctggaaatattgatggactgcccttgaagtataccggtgagtctttgtccccggctgtcctttcagaactgggccctcttcctgaaccaaaaactgctgaagattttgtaactagagggaaaatcctgatgggcagtagcgattatacgggagccattgctgcatatgaacaggcaattgcactttccccgactaactatcaggcctggcgggataaggctctctgtctgaaggaactcaaacagtatgatgaagcgatgcaggctttgaataccatcctacccatttataaagaaaaaccggaactctggtctactgcaggagatatccttttagtggatatgcaaaaatatgctgaatcgattccattttttgaaaaagccatatcactggacagcgaggatactcattcactaattaacctggcatttgcctatgataaaacaggaaatccggaccgtgcattagaactataccgtcaggcattagacattaacccctcactcactgatgcatggaataaagcaggcaatattctcactcgcgcaggacaatttgaggatgctgtgagaatgtacgacaaagggctttccattgacccgggaaatgcatttattcttaacaataagggttattcgttatttttagctggaaaataccctgaagctatagaatcccttgagaaagctgttatcttagatcccaaatataaatcagcctggaaaaatttgggggacgtattcaaagctatgggcaatatagccgaatcagaacgagcatatgctaatgctgcctgattgatcagctatccataatacttttttacatgaagtgctgatttcaatacatgaagcggactaccgttttcatggttagtgtttgtatcatggttctctctctggtagcgactggatcagcatggtattcatccagctattcttctcaatatcaggcatcatcaggatgtgcatgggatccatggttcggaacacaatgtggatactctcaaagctacagtcagcagtcgagcacctcatatgggggatattatccatggggaggaggatggggaggcagttattacagttcctactcttcatgggactttggaagctggggattctgggcaaatgggacacagattgaggatgtcaccggagtatgggatacagatcttctcggggaaatgaatctgaaactgaccggtgatgatatcatccgtggttcatacatgaatggtgaaaaccagggatacatccagggtaatttcagctactcaaatgagacattaccgaccatggatggtatctggtgggaagagccaacataccagcccccgtattcagcaggtgtaattgagattaccttcctgaactcaacagcacttgaaggtatattctcttactctgacggaacatggggaccgttcaccggaactaaggtcagtggcaaccttaccgaagagaccgaggcaatgcttcttgatatgccagaagtgaactggacccttaattacgatgagcagaaagattatcttgtcagcaatccaccggaagagaacccggtgatgcagcctggcgaggaatctactgtttaaacattctccttttttgttcatttattattttgaaatactcaatctttatctggcctatttatctgccagatagaattgcgtttagaattatcgtttcgaattactattcgttacactggtaagatattcgtacggttaccattgtaatataaatataatgataacgtaaactctccaatactcacacaattgatgggtgaataaaatgggaaggcagggaactgatgattacctggatacaaccggatatggtcaactccagtctgaaataaaaaaggttatagaatttcataaatccggtttatctgataccaggatagatacaagcaggatgtcagatgaagaacaaggcgtaggatctctctttaatgaaatattagatcaatatcaacattttttttcaatcatacgggattcattaggatcaattcagaaaggtgattttcatacagaagtatcaaagctacctggaaaatttgcggatattactgatacgattgacagcattcgctccagcctgttaatgcttgaaaaagatatcatcaggttctccaattcatttgaacagggtgatctgacactcagaattgatacaacaaaataccggggggggtttactgatattgtagagcacctggatcagggtattgaggcgatcaatgtgccaatacggctggtctctcttgggatttctgattttgccgagggaaaaatcccagatatcaatgatgaaaatcagttcaaaggagatttcagaagattaattcagaatttaaatcagattgttcatgtctccaaaatgcgaggagaagatataaagactctgatcagatcagctgaagaaggcattctggatgcccgggcagatcctacaaaataccctggatatcacggaaatatgctggcaggaatgaataaaatcctggatgcgtatataagtcccatcaacgtttctgcagaatatatagacagaattagtaagggagacatacctccgaaaattactgaggcataccggggagatttcaatgagattaagaataatctcaatgcccttattgatgttgtccacatgagaaattctgatattaacatgcttattcaggcagccctggatggaaaactggatttcagagcagatccttcaaaatacccgggtgaaaacgggaagatgattgaaggtattaataagatgttggatgcatatctggggccattgaatgtatctgctgaatacatcgacaggattagcaagggagatactccaccaaagatcactgaagaatatcgtggggactttaacgagatcaaaaacaacctcaataacctgattgatgtcattcttatgaggactgctgacattaaacttcttacaaatgcaggtcttgaaggaaaacttgatgttagggcagattcctccaaatataccggttatcatggaaagatgatagaatcgattaatagcatgcttgatgcatatatcggaccaattaacgtatcagctgaatatatagacaggattagcaagggagatattccgccaaagatcactgaagagtatcatggagacttcaatgagattaaaaataatctcaacgctctcattgatgttgtccacatgagaaacgatgacattaagatgctcattgaggcagcgatacagggaaaactcgatgtaagggcagattatgcgaaatatcctggtgaaaacggtcggatgatcaagggtatcaatgacatgcttgatgcatatatcggaccaattaacgtatcagctgaatatatagacaggattagcaagggagatattccgccaaagatcactgaagagtatcatggagacttcaatgagattaaaaataatctcaacgctctcattgatgttgtccacatgagaaacgatgacattaagatgctcattgaggcagcgatacagggaaaactcgatgtaagggcagattatgcgaaatatcctggtgaaaacggtcggttaataaagggcattaatgacatgctcgatgcatatatcggaccaattaatgtatcagctgaatacatagacaggattagcaagggagatattccgccaaagatcactgaagagtatcatggagacttcaatgagattaaaaataatctcaacgctctcattgatgttgtccatatgagaaacgatgacattaagatgctcattgaggcagcgatacagggaaaactcgatgtaagggcagattatgcgaaatatcctggtgaaaacggtcggatgatcaagggtatcaatgatatgctcgatgcatatatcggaccaattaacgtatcagctgaatacatagacaggattagcaagggagatattccgccaaagatcactgaagagtatcatggagacttcaatgagattaaaaacaatctcaacgctctcattgatgttatccacatgagaaacgatgatattaagatgctcatcgaagctgcacttgatgggaaacttgacgtcagagcagatccttcccgctatccaggtgaaaatggtcggatgatcaagggcattaatgacatgctcgatgcatacatcggacctattaacgtgtcagcggaatatattgaccggattagcaaaggtgatactcctccaaagatcactgaagagtatcgtggcgatttcaatgagattaaaaataatctgaatgcactcattgatgtcatacagatgcggggggcagacattcagttactaacaaaggcaggcatggaaggaaaactggatgttagggcagatccttcaaaatactcgggctatcatggtaacatgattaaaagcctgaacaatatgcttgatacctatattgggcccttaaaccttgcagctgaatatattgatcggattagcaaaggtgatctgcccccaaaaataacagaagagtatcatggggatttcaacgagcttaaaaataacctgaaccagtgtattgatgccatcagtcttctgattgaagatgtgaaccacctgtctgaatctgcaactgccggagaattacataccagggctgatgtgaaccggcatcagggatcttatgcaacgcttgtgaaaggaattaatgaaacgctcgatgcagttgttgaacctattgaagaggcaatgagagttgcgaaagagtatgcccggtgtaatctggcaacatcctttaatccaaatctagttgttaaaggcgaatttgccgatttcaaaaattcacttgataaaatcggcacagatatatcaaaaactattgaaaacctgaatgaggagattgaatctctctcaaaacattcaaacaatgcacagtttggtgttgaggatgtcagcaaaggtgctcgtgagatagcccagaatgctgaagagacatcaatgaatgcttccaaagcagaagagggaattgatcaggtcctacgtgctatggctgaccttaccataatggtaagtgatatttctgcaaatgctgacgcagttgcaagacttagcgaagatgcaaatacgctcgcaaagaagggtactgaatatgcaggtgctgctgacaaaggaatggagagtattaccagatcatcttctgaagttgagcagattatcggtgcaatcagaagtgagatggatcagatccgtaaaatcgtcaatatcatcaccgatcttgcaaaccagacaaaccttcttgcattaaatgcagctattgaagcagcacgggcaggtgaagccggccgaggatttgcagttgtggcttctgaagtaaaagccctggctcaggaatcacgaacctcagctgaatcaatcgctgatatgatcatgggtcttgaacgaaaatccgatagtgctgcccatgcaattgaagcagcaggaaaagctgtcattgaagggaacagtgcattatcagataccctcaatgtttttacagaactcacaaaagctgttgatgatattaatcagaagatgctgacaattgcacaagcaactgaacaacaggcagcctcatttgaggagatcacagcaagtgcaaatgagatgagtacgctggtcaaacggactgccgatgatgccacccattcttcagcaacaagtgaagaagccctggcagtggtatcgcagattaacggaattataaatctgattaatgaagcagtcagtaatatgagaaatgaaatggaagtcttcacattaagaaaaacttcctgattttattttattgagattataaaatcgtgtatctctttaggagataatacacgatcaacatcagtcagacggaatgcagcctcaggcatacttctgatagtgcaggtatctggatcctggataaacacctgtgctccaatctttttcatatacgaaagcccctgcgctccatcactccccatcccggataatatgagaccatagagaaaatttcttggatctggagtcagggacatcattgtcacatcaacagaaggacggacaaaattgactttctctgacttatcaagtacaattgtttcattatttttaaggaggagatgattatcgccgggagttatgaaaagtgatcctggttttaagacctctcccccgtttggtacgatgacgttcatggaactcagctgggagagcctgcgtgcaaatcgggatgtagtagattccggcatatgctgaacgattactattgccatcggtacagcaggtatgccggtaaagatgtcaaatattactcgtggaccaccagttgaagaaccaataatgaggatgttcattatatgtaccgcactaatccaacatggttatataatcatcaaccagcgcgatgaggttttctggttcaaaaggtttggtaatataatcaaagacatattctttcaggtggtcaagagaagtatccggaacatcctttgcagtgaacatagaaatgatgaggtcatgcatcagattccggtttacaatctcctgaattgtttcccatccgtcaagacctggcatcattatatccattaaaatcacccctttgaatcctttttccagataatccagacactcttttccagaatgtgccagaaaaaccggaaatgggcgttttctaaataaagagtgcacagtaaagagaatgtcctcatcatcatctacgaccatgagaccagattgtgaacttgatgatataggatcaattgatggatccatatgaaaattattgtgattcagactatattattctgccttattattggttaaaaggattgtcaatttaaaaaacttctgtagtgctgattcaggagatggttaggtaaccatggtttatttagaaagatataaaaaacctgcagttggtttatttgttcattcatagaagatcctatcacattaaaactttgattgatatgaattcagataaaccatttacaaaatttcataaaaaaaataattaccggataaagaaaagggacgggggattaccagaaagccggcagaagagtaccaaacaggtaaaatatcaaagaaaaattctgaaaattccttcccggctggaacgattaattgaaaaatatattgagaataaaacaggtaaacctgtggatactccagcaacacttgaacgaatcagacaatctatccttgctcagaaagcaggatactggagtaaaaccccgcatgcaaaatatggaagaggatatgatgttttcgcatatcttgcctaccaggctccgtgttatataattcaatttcattatatcatccagagacttgataaatccggagtttttccagagaatatcagagtacttgaccttggaaccggtcccggagttgttccgctcgctctcacatggtttatgaaagagaggaagaaaggaacactcaccattgatgccatagagcagtctgaagaattcatagaggcttttaaatttcttgttcctgaatttgcatctgaatcgccaataacaactgaccttttacagcatgcggatatcagaacatggcagccgcaaaactctggtacgtataccatgatcacctgccagaatgttctggctgaacttcctggagagagcagcaaagaaaaagcggacctcctgataaaatattgttcatcattgacagatgatggaattttgattctggtagaaccggcagaacttagacattcaactgaattgcgtattcttcaaaagaatctggagaaatcaggattatttctctatggtccatgcagatatatccatccgggcccatgtgaaccggaaacatgctggtcctttgcagaactttctgaattaaaacccccacgattgatggagttgttaagtgagggtcaggatgggtatcggtttatgaataccgatattaaattttcctatagtatcttcactaaaaaaccacttgctccggtttgtcctgattcatttattcaaggaaccataccgctcggtgaacttgaagattaccttggagaaactgttaccattgttggagcaaagatgtcaatggacattggtaaccgggaatttgccatttttctcatatgtgacggatcaggaggagcaaaagtttatcttattatcccccgctcattaaagaatgaagagattaaatcggtaaaaattgcagattatggagatattttaaaaatatcagaggttcgtgtcagatggaatccaaaaaagggatcatttaatcttgttgcaggtgcacgaacacgagtttctgcaatgcataaatagataaccggttaattgttaatgagtattgcagacaagtgtttcaatacagggtgatcgatgtcagatgaagatcccataaaaattctgcaggtacgctttgcaaaaggagagatatcagcagagcagtatgagcagatgctttcttttctcatccgggatgtttcatcatttaaacagacagaaacaaaagagaaacctgatattattgaaactcctttggagcaggaaaccactccgactgtagaaccagaaaaacctgagtttgctgatgatgctgaagcagaagagattgcagtcatcgaacctgattcaacactcaccgaacctgaacggacgacggtaaaagagatcgcaacagcaatagcaaatgccgaagaaccggtttcttcagacactgaatcattgggaatagaagtaaccgaagagacggaaactaatgagagtgaagaagtaccagctggtgaagaagactttgcggctggcactgtacttgatacctcgatatctgatgagcaaattgaagcgattgaaatttctgaagagatcccagaggaagtaacagagaaaaaggagagtgctgagagatttttatcccaggaggatctcggaaatgtctgttatgttactgcggtaaatctggtccaggccggggaatttgaaaaagcatatccctttatcgaaaaatctctgaccattcaaccagaactgacattatcttggctttataaaggattcattcatcacaaccggaaggaatacgaagaagcaatcacctgttttgataaggtactagctaaagatccttttcaaatccgagcttggctttttaagggatacagcctctttcatcttcatcaggatgataaggcgcttgaatgctttgatcgggttataaaggaagatagaaaacaactgcgagcaattatttataaagggtactgtttaaaaaatctgaagcgttacaaagaagcagggaatgcctttgataatgcaatccagctcagtccgagagatctgaatcttcgactgaacaggggaatctgcctctttgaagataagcaattttatgaagcactaaatgctttcgataaagtattggaacttgataaaagaaatttatctgcatggctatacaaaattcgcagccttatcagaatggaacggattcaggaagcttttcaaagttcaggtaaacttttagagattcagcctcgcgaagtcagcgtatggcttgcacgagctgatcttttattaaagatgaaaaaagttgaagaagctctagatgcaacaaagaagagtcttcttcttgataaatggaatcctgacacctggagtctacgaggattgtgtttttataaacttggtaaattcaatgaggctttacaatgctatgataatgccttaaagattaatccaaaacacctagatgcgatgaaaaatagggcattgtgcctacataaactgaaacgtcatagcgatgctctggaatattatgaacacgctatcgccggaaatccgcataatattgaagcatggttcaaccgcggactaatcctccataaagcgaaaaattacgacgaagcccttcattcatatgataaagtgatagaacttgataaattccatgcaaaagcatatttcaacaaaggtctgattcaccgtcagctcgaacaatattttgaagcattacaggcattttcacaagccacgagtgttgatccctcatttgcatcagcatggtatcacatgggtctgatatatacagacctcgtcagacataaagaagctctgcaatgctatgataagactctgaagctaaatccaaaacatatcggtgctctcctgaataaaggagtaattcttgaagatgccgggctgaaaaaagaagcttttatgtgctttcagaaagccgcaaatctggatacaaaaattgcagcttccataaaaggaagacttgcacactaattttattcttcaggtcccgtgatcccagcttcccatatattcttcttgatcttttgtcagtttgtcaatggaaagattcagggatgcaagtttgtatgatgcaaccatcctgtcaatctcatcagggacctgatgaacatcaggctttaattcaacatgatgaagggcaaggtattcggtgctgagtgcctgtaatgcaaaggagagatccataacttctattggatgacccatcccttttggaactgccagattcacaagacggccttctgcgagtaaatggatgactttaccgccgatatgatatgaatgaataccatcgcgttcttctatagtatctgcatgagaagagagccagatgccatcgatctcgatattaaagtgacctgcattcgatagaatgacaccggatttcatgactgtcatgtgatcaccggtaatgacatccctgtttccggttgttgttatgaagatatcaccaacccgtgcagcttcctgcatggacatcacatggaagccttccatatgtgcttcaagggcccgtcggggatctatctcggtaacgataacttttgcaccaagtgctgatgcttttcgtgccagaccgcgtccgcaaaaaccaaatccagctactacgatccattttccggcaatgagagaattcgttgttgccatgattgcggtcagagcactctctcctgtcccgtgcacattatcaaagtaatgtttcattggtgtatcattgactgcaatgaccgggaagaggagctttccatcagcagccattgcacgcaaacgatggatcccggtagtagtctcctcacatcccccaattacaccagaaagaacatcctgccttacggtgtgaagacgatggataagatccatcccatcatcaatggtaatgactggttttgcatcaaggacagtatcaatggcttgatagtattcatcaaccgaacatccgcgtttggcataacagtatacattcgggacctttcctagagcttcagccacatcatcctgggtagagagtggattacacccggtaatatggaccgttgcccctccatcagctagtgtcctgacaaggttcgcggtttttgcttcgacatgtaaagccattccgatgactttaccagcaaagggcttttcttttttaaatcgatcagagatggcgctgagtacaggcatgtactgccgtgcccattcaatttttaaatttccagaatccatggtttcctcgtaaggtacgaatattaggaaaattttccataagtgtttctccggtagtattaaatcatctctccataatcctcttttagtacagcgaacaagaagctacaccaatgacactgacccggaggattatcccctgcctggacatcaaggacggaagagttgtgaaaggaacaaattttcttggccttcgggatgccggcgatccggttgaacttgcctgccggtataatgaacagggtgcagatgaagtagttttccttgatattacggcatccagagagaacagggggatgatcatagacgtcatccagcgggctgctgatgaacttttcctcccactgaccgttggtgggggtatcagaacactcgacgatgttcaaaaaacattgagagccggagctgataaagtttcaataaatacaagcgccgttcagaatcctgcattgatatccgaagctgctcaggcctttggaacccagtgtgtggtcgttgccattgatgtaaaaaggagaacctctcctgagcctgggaagaccatgatacctctgccagaccagagttcatgctggtacgaggtagtaacacacgggggatcacaaccgaccggaatagatgctattgcctgggcgaaagaagctgaaaaccgtggcgcgggggaaatcctgcttacctctatggaaaccgacggaacaaaggaaggttttgatatacccattacatctgcaatttctgaatcagttggaataccagtgattgcttcaggcggagtcgggacttttgatcatttttatgagggctttgtgtacggaaaagctgatgcagcccttgcagccagtgtctttcattatggagagatgacaattgctgatgttaaagattatttatcgaaaaaagggatagcaattcgccctcatacgcaataatttactctttttttctcccgactgatgccatatatatacaaaactctgactctccgtctatccccagaatacaattaatatcattatcattgtatgagcctatcgcacatactccaagtgaaagacctgcgcataccacatacagattctggcagatatgaccagcttcaatgaacagatatctccatcctctctgtccgaacttccaaatcatacgttcaggaacagcggtccagatgaaggatactgctgatgatgcaaccaggtttggatttctgcatatctttgctacagactcatgatccccggaatgacactcttctttgacaagagcatggtcaagggggaggtaccgatatatacctggatccaatccatttacccggtttaccacaatgcgtgtttcaaagggatgtaatgcacctgctgaagggacagtccgaaaatttgaaccattctccttttccctgacaccctgggtataatgaaggagaatagatagttcccatttatgtatctcttccgaagaatatacgcgaatagactttctgtcatgtaaggcatcccataagataacgggagcaagagggatctcacttggatctggcaagagtatgatcttctgattgggttcacatacgccacatacacgggttttcggttcttcttctatttgatgagaatctcgaaagagtgtttcctgaagaaaccggtgaccggtccacgaggagtcagattgcatgtatagcaataatgcgtgacagctacctgaactttacgataatgagatgagtgggaggagtaagcccccttctgttcattgcggcattcagcttagcaccgaacccgggcagataccgggttatctgtatgccctgtttcggtttgcacccgcagggattcgccgtttcatcggtgatgtccgtcttcgctcagcaggaatgcatcataactcaggacattccgtatcgtttctggtccatagccgtgattctcaccacccctgacaagcaaggctgcgtacccggttggtggggggactttcctcagctacgaaaaatcgttaccgtcggccgcactctccctctcatatcttaatcagcatcaaaagagaaaaagaatatgtaaaaattactacctggcatcagtaatagtattgggtgaagagaccggtaatgcccgataaaccgtcatttatttatagaaatatcctgattattctaattacgaaaggggaatcgtattaccactattgcatttatccatcataaaggtggaacaggaaaaacaacatcctgcctacagatagcagggatcctaaaaaatatgggaagaacagtacttgtaatagatactgatccccaggcaaatgcgactttaggtcttggagtctatccggattctcttcagaaacatatatatcaatattacatgcagagatgttcatcatctccagattcagttctcctgtcagattttatcataaaaactatgtctggcatagatctcgtcccctctcatcttgatcttgtcggcgcagaagcgatattatacaaaaacccggaccggtatcatattctgaaaagggggattgatgtaattaagaacagatatgatcatattctgattgatacccctcccttccttggtcaatttctcatgaacggaatgattgctgccgatcattctgtcatggttttttcttctgatttttttgctgtcgccgggtatgatcatattaacatgattattcgggacatcaaagagatcttgggagttgatattcatatcagtatggcaatcctgaacagatggaataatccatcagaaaaaacagaaacttttctggaaaaaatacaacatttgtttggtataaaaccggaggtacaacctgactcattgcaggatatacgaagtcagcttgaagacagaatacggatagaaatcccggaagtaatcctggttgcggaaggaagagatgtatctcattctttaaaacaaggtgttccactaataactctggctccggatgatccatccatgtcaggatttaaaaaagcagcattagtgatagactcatggaagacaagggggaaataatggatacaggtgagaataaacattcggggagaagagggctgttcatggtcactgaaaatgataaaaagcagccagaaaaggagatggttgttccagactatacagaaattatcaacaggattctgaactttaaacagggggaaatcccggaagtaccggaagagtttgtgccaatattaaaccggttacaacaggacactgaaatccttcagaatgaaaaacaggccattctagaactgaccagagaattagatctattgaaagaagaacaggacataataaaaaaggaacatgaaagttacctctccgatctgatttccgctcatactgaatttgatagagcactggagatatttcagtatcataccatccctatggttcttttgggatctgaacagcagatcatggatgcaaatgacatattctgctcgatcttctctgttgaacggagtgaaataaccaggcattttccacctattactaaatatgtctctgataaaccaccttttaccgctccggacggcaaccaatattctattgttacaataaaacccccaattgttccttttgatcatgatgcagtttcactcgaactctttataccctatctgcccccgggagagccgaaaacaaaagaagtagtatccagagagatattagagaaagcactatcaaaaatccttcttccggttgcaataatcgatgggcataacacaatcaaatatataaataatgcacttctggaatatcttgcacgggattatcaggatatctatcttcgtgatattgcaagttgtggcttttccggagagataaaagaaaaaattgaagaaactataacaaccggaacaaaaatcgcatatcagacatcaattctgcatcgtgacaatacctctattcaggtatggatcgaattatttcctcttacatgtgaagaagaggcatacattttactcgttctcttccctgatgaagaagaggaggtcaataataccgaagaaatctctcagaatctttcggaactgaggacgtcctttttaaaaactcttctggacctcaatccttcaccgatggttctgtttaatgatgcatctgaaattatcctcgcaaatgaaggtctttcagagcttataggcgtgtcttccgaacaattacaaggccagagattgtcagacatcgggattagggtatccggtttttctggaacgagtgaagagatggagatacttccagacaacatctgtattgagtcaccatatggggtgcaatgttactcaggtctcctcattgccaatcatcaatcaaatcagaatcaatatcttctgattcttcaaccaccggttgatgttccaatccagcaggataagcaacaaagtccggatatcattgaaacagtacagaatgattcaccgtctattcagacagagactgatattcatccagatttttcccaatcaattcaattctcttccatttcgattcccggacttcttattgaagattcaattataaaagaaattaatcagtcatttaaagattggagcggaattcaggatgaaaatatttcagaatatgcacaaattctcatctctcatacggtccaggccagggagaacagatctttggtattttcatcactctatcccgcaggtctgaaatcatatcagattcagattcagccgagtatctctttgcctgataaaaatatctactggtttattgatcaatccgaagcacaggaatcaatcgcatcattacagaatcagatagagagtttacattccgaactgacttcaataaaaaataatcttcaagaggaacgttctgcaatgaaaacttctgaagatatatccgggcagatagatatcgttgaatttgaattatccggtggaagatatgcaatggatattgggatggttcgggaagtcgtcgagatgcttccaataaccccacttccaaagactcctccttatatcattggtatcatcaatctgagaggtgaagtaacccatgtcatagatcttgcagtacttcttggagaacggattaagaaagaccgaagtggccagaagattatcatcgttcctcctgatgcagcgcatggagaacatcttggaattattgtggataatgttcgaagtgtcaccgaaatcggggtgcgtcaggtaactgctcttggagatgaaatcaatgagcggattcaaaccaggattaaaggcatcattaaggtcactcatgatgaccttatagagaaacgtgaaggagaagagaaggaagcaaaccttgttatttggcttgacatgaaagaaatattaaatcgtatggcaagtcttcactaaaagaattgttctcctttgaaacatatcatggataaaaaaattataccccccgtttttccccagattaatgtcccacaagtgagtgagaagggacttccggaactcattcttgatgttcagaaaagactcaatattcaactcaccagttacaaacaggattatatcaaacgaaggcttctttcacggatgaattcaaccagatcaaaagattttgttgaatatcatcaatatctgaagactcatcctgaagaagaagaaaaactcaggaatgcactgactataaatgtcacaaaatttcttcgggatcctgatgtattcaatctgattggaaaagagatctttccatcaattatccaggagaagagatccataaaaatctggagtgctggttgttcatcaggagaagagccctatacttatgcaatactcctgtatgatcaggcaaaacctgggatttcactcagtaatgtcatcaccgcaacagatatcgatgaagtgattctaaaaagggcaaaagatggaatttatgagaagaatgctttggaaaacctgagtgattcccagattaacagacatttcgataaaactgaagatgggaagtaccggataaaagatcacatcaggaatatggttcggttccaacctcatgatctcatgaaaggtgttccggtcgcacggatgtttgacgtggtatcatgcagaaatgtaacgatatattttaatgaacaacaaaagaaggatcttgtaaaactcgtttatgaaagtctggggaataatggatactatattatgggtatgtctgaatatatgtcaaaagatgttgaacacctgttcagaccctataaaccgatgcttaaaattttccagaaagcagcgtaaaaataaattatcctctttttagaaatcccttttttctcggaattggctccaggccagataactcccggtttttatcgatcttttcttcatgcgctttaatttcgctgtaaataatataaaaattcagacctaccaggatcagaacaaagaaagtactaataaacaacgccagaccctgggggcggatttcttccacggtccacatgatataaagcaccagaagtaacccaaataaataaaatggtccccacattctgatgttcaggattttcatgtgtgcttccagatttcttttcatacgatatcaatctcacggagtgatcatcattggacacatacaggtccatgagatcaggtgaagatagataactaaggccgtctaatgataaccatatgaaaattatcagggttccaatttccatacaaatcattgctatcctgatgctgtgtgcattcattaccggatgtgttgaggtgacacctccaaccggggaacaggaagcgtcatcatatggaccggtttcgcaagggagtggggatatgaaagatctggtaaaaaatcagaatcagaccatgactcctccggttcagtcaccaggtccatccgatcagcagggagcaactgagccggtttctacttcttcacctgaaacaccattaccaccggttgaaaacgaatcatttgtaaaagtaactccgaaagattacagccagctcaagggcgatacacagacttcatatctcccctataaccgaccaatatcaacagacaaccggcagtttatgacaatatatgagatattaaatcagtcattcatgaaaaatgcttctgcatatgcatatcaccttgtcactccgccactctatattgaattaggattttatccaaaaatggtaaccgacgaacaggaagtctataaaagaaccggcgataaagaaggaaccattaagtataccaaagtcaggccatcacaggatgcatggtttgaaatgcgtgtatatgatatggacacaaaccaggagataatacgggagggatatggaaaaacatacagcatgactaacaaaacagcagcaatccgcagggctgggaccttccagtttgactttatgggtgactcaattgctgctgatattgcgatgaaaatcccggtcgataattcaaccgtgaatgcattttcaaatgtaagttcacttattgaagataaaaaaatcaagtccggattactaccatcagtatttctgcaggagactgatatgggtcagggatggcagagaaccggagatcttattcatactccggtgaaatattcatcgattttaattctaccctcatcaggctcgaaactgactcaggatatttccaaattcccgggttctcaggatgctgttacacaatatgcacagacgaaaaccgcgaattcaggagaaacacacatagctattaccgctggtgatgaagggtatggatttgagtctatcagaaaaacaggtgtggttttcagacagggaccatatcttgtccagttgaccagttattctgtccctccggtctctcttgatgaattaaaaagacttgcaacgttagtttccggaagaataacccagacaaattaattttttatttttgaaagtaaattcagatcattaatattgcaaaaaacatccttatccgggaccagagcctgaatttcctgaaccggaatataacgggtatgaaggtcctgaatgagggatgaaagacgtctttcatcatttttttcataaaactctctgacagcatcacgacgatatacagcgcagagtggttcatatctaccatcttcccataccggaaccgcggcatcaaatccttttactgcgttaatcaggtgtctgataacaatacaggacaggaatggcatatcacaggcagtaacaaaaaaatattctcctcctgcatgccaggccccggaatgaataccccctgccggcccctgacctttccgtaaatcctgaatatatctaacctgatttaatacagggagaactgctacctgatcctcatcacggcagactatcaggatttcatcagaacaggacctgagttcttctgtctgtctctccaaaaaagtcttgttctcataggtaaacagatactttggatatccgttgaccctcgtgccaagtccgccaaccagtatgagtgctgaaatcatgataaatggagggatgagtttgtaattcccatgcgttttctaacccgttcttcaaggttcagtaaatcctgctttattgagatatctggcgtatatccacccagacctccggttgaaacgacccggtgacaggggatcaaaataggagtaagatttcttttcatagccattccaacaacccgtgcccctgttccaactgactctgcaatctccttgtatgttctcgtctctccataagggattgtcttgacttcccggtaaatcctaccaaataccgtatcatcctgttcatgaagactgcttagaggagaaagagtagtagtctttcctgccagatactgtgaaagggaaagaggaaccggaccggaaacaccctgtcttacaaaccggattctgctgacgacattatctgaatcccatctgatatagacaaaccagagtccaaacctggcagatccttccattaattccaaccttttaacaatgaagggaatgaatgaacattaacttcctgtatctcctcctgcatccagcctggcagtcgttctttaatggagggatccagaaaccgattatcgccgatgataagcacacccctgtcttccggagtccggagaactcttccaagtgcctggagaaccttgttcagcgcaggaagtgtgtaggcaataaattttccttcctcaccatattgcctcgtataatagtgcatgatcatctgtcttacctggttccacggagcaaggggaagaccgatgaccatggctccggtcaacatctctccccggtaatcaagtccctcagaaaatttacctccacatacggcaaataaaattccttttttccccttccctggcagactcataaatcttgtcagtaatggtcctgcttcactgctgtccctgggctcaataaatacctcacggtcatgaagatgcatctcaacttccctggtaactgattccagcatctggtaagagggaaaccatacaccaaggtttccagggattgtacagaaggtacgtatataagagatcatccttttcaaattttcatctgactgccgctgagaatatgccgaggtgatatctgcagttgtgagtacaatccgattcttttttggaaaatgattgggaagtgaaaatgatgaaacaggataatccacaggaagggctctgaaatagagctgctgataactgctcagcggtgttaatgttccggaaatatatacagaacagaagtgttcacgtgcaagagttgagagagcgggagatggatcaatatttctgacttcaagatagatattctcattatcctttcgaaaaagtgtaaggtatgcaggatttgtccctgaattgtgaagccggtacaggaatgcagagagtcgttcaatcccggttgttctgaaatcaccccgtttgctgtttgtctctcgaatattttcagcaagatccatgaactcatcgacaacctcctccattgtgccatagagtgactcccgaagtatcatacgactgaataactggggatcaaaccagtcctcagttacagcagaccgacgaagaccatcaagaaatttttttatgccaggaataaggcgtcttattgcttcaaggtctttgacttccttttttattgaggaaatatcatgatctgcctgttcaagggcccgatgatcaagactgactgacataatatcctgcatcacatcgccacagttatgtgcttcatcgatgagcagcaatatttcagaaggctcccgttgcagattcaggtataactgctcccggatctgctcgtccatgatatgatgataattacagatgaggacatcagcctgtaatgaagcctgtgccatgacctcatagggacatagccccccacatgattcgcgtagtgtgtcaggtttaatacatctttcaataacctgagtagaaaggcgtttacatgcatcagacggaaccaaacgaagacctccagccttttcattctgaattgccattcggcttcggataaaaaaaggacagatgatcggatggtccggatcatttttccttatctgatctaggatgaccttatctttcgatggatccaatgatccccgatcagcccgctcccggataagcgccgttgagaatcccttgacagcctcacatttccggtaggtatctcctgaaccgcccagaggacacattgaacttttcccaaccagatatgaaaattttaaacaaggttgttttttccgaatgagttctagttcccgtatataggtggtaagctgggatatggtccggactgcaacaattatctggcggtctctacgtccagctaataatgcagagacgacagaagattttccagatccggttggtgcatctatgaggaggacgccacccgttctggcagtttcaaaagccctgtgtaacatttcttcctgtccgggccgaaatgaagaataggcaaaccagtcctgcaactcattcatctgtagctgattgaccctgaatgcttaaagaagatacgaatgaccgcaaaaaatgataaaagaaatattatataattccgtttttattgaaagtatcagaatattttttatcagttatctgaatgtgatttgatacccagtccttaagaaatgtcataagttcaatagttatccctaatttgttggcctgataatcctggataagtgattcaactttcccaacaaaagtatcatgctcctttttatgaaaagccagtccagggtaaccacactgctccatatatttctcttcggttgaaaaatgatagactgtatatgctgcgagctcatccagaattttcccaaggacttcctttccctttttttccagcattgcatcgtgcagcgtgttgatgagctgaataagtttttgatgctgctcatcaatctctgtaacatgaacactcagggattcagaccacttaagaaatgccatgataaagctctacccatccttcatataatatttattcatgaaatgaccgatactggtttttcctgtgaaaattatatgtaaacaaaaatatattgatactatggatattatacagaacacatataatctgaagagattgttcaaaataaaatttgtcatcatttttactattttcttattatatatctcgggatttagttttggtgatgatacatttgatgagaatatcctcataacctatcctgtgacattagaaaaacctggagtctattatctgaatgaatcagtttttatcaatgattcagcaattcacatcacccattcagatatcatccttgatggacatggcaatattgtaacaggaaatatgtcttcaggatcgatcggaattacaatacaacatcctgaaatgatgatgcataatattacaatcagaaatattaccataagggattttgaaaccgggattctaatcgatacctcacatgaaatcaaccttgaaaaagcagatcttatctctcatatgagaacaggaatccggatagagacatcagagaatatacagataaccaggtgtacggttcaaaataacagaaatgaaattaccggtggatacggtatccagatatcagattcgaataaaataaaaataactaactcccaggtaaccgggaatgggaagactggaaaaagtaattcaggaggtatttatatcactaactcttctgagaccagtattatttccagtcagatctctaccaatccagggtttggtattcgggccgataatggaacagaacatctaaaaatatcagattgtgatatttctgtcaattcaggagatggaatactaatccaatcaggttcatctccagacatccaaaaatcaattctggataaaaacaaggaatcaggtattgaactgataaaagtggtgcaacctgtaattaccgggaatgttatcacttcaggcaccatggggatttctctcttagatactgaagacatgacattaacaggaaattcattaaaaaacaaccggattggatttgatatctctgcctcagatattcgttactataatcaccatatttcaaataccaatacgatagactcacgaacactcatctatctgaaagatgtccgtgatagaaagattggaccatcaatgaacccttcgatggtcatcattgtcaactcatcggatattgcattgtctgaactcgtgctatcaaaaaattgtgcagggattatccttgctaatagctcaaaccttaccctcacagatatttctttcatagaaaatggtattggcattaggtcagaatttggaacaaacaatctgatatgcaacaatcttcatgcagaaagaaacctggtgagtggatattatataagcaataccaataattttaccctgacatcaatctatggtcaggaaagcccatctggcatctatcttcacaacgcaacaggggggatattaaaaaatatctatatgacacagattaccggattaaaatcacgaatgccttcagggattacgttgagcgggtgtgacagtatcaccgtttccaagtcacaattctctgaatgttcttatgcaggacttgtatcagactctgataatctgaatctcactgataataggtttctatccaatacctatgccggttcagtaattctctcaggcccggtagatctgtataataattcattccttaataatgaggataccggccttatcttaagggcaaatcagagtactatcctccgtaatacattcaccaataataagaacagagggattttattgatttctgggaacgaaaatctctttgcatataatacctttaaaaattataaaaactgtatgattcaggataaaaatgctattaatatctggaacacctccaacatgtatttttctgataatacttatccagctggtaattactggggagatcctgaaggtgagggattttcggatatatgtaccacagatccaaatggttgctgtattgatccctatattattcaattgtataacatagactatcaccccttatcatcacaatatatcatcgaatctaccatgaatactgacctgaaccagaatggccgggaagatttgcaggatgtggtgaaatatatgaatatggtctcatctggtgataccagttcattatatgatttcagtggtgatgggaaaattaacctgaatgatgtagtttcattatttcatataataataaagaaataaaaaaataaattagagatatcagaatattgaaggaaaattattctgttttataagaaaatatttcgtttttaaacgtaaaatggaatagaaactattttttattgagatgctgaagtttggaagcactattgtcagagtatttaaaatcgaggaacgatatggaggggaaattaataaaatggagttgtttacgcatgattaataggagggggcttcattagtgactacctgtgatgaaaataccggctgtttatgtgaacatacgccggtcgataatcccgtgcctcttgcaggaagagcaaaatcattacgacttcaacggggaatccgtccctggatggcaagtctgattgctatcggagggatcattggttcaatctactacctgggttcaggctatcttattgcggaaatgggacctagtgttatccttttgtatgctataggaggtcttgttatctggaccgtgatgcagtcatttgccgaacttctggtaaatgtccccagacagggtaattttataagtcattcggcagaattcatctcgccaacatgggctgtcggaactggttggagttattggtttaactggtgtgcctatattccatctgaggctgtggcagggggaataatcatgcatgtttttgcccctcagcttcccatagttgcatgggccgttatatttcttaccatgattacccttctgaatattattcatgtaggaggatttggatttgttgagagtacgctctcgcttataaaaatcattcataacggagtcttttgcatagttgcagcccttatcattcttggctttataggatccggaggcccgatcggattgagtgtgcttttcccaccgaatagtgatccctttacggacatcttcccagccggagtctttatcctcatcagtaaccttgctctcattcttgtcaactttcagggttcagagattgtcggactcgccgctgcagaaacgcaaaacccggacaggattgtcccaaaggcatgtcggcaggttgtataccggattctacgtgttgatatcatccccatcttactgcttgtcatgatcctgccatattcggaagcgggattgtcagatagtgtattctctctcgctctttccaaatacggatttacagaagttgcaggaattttatcattcatagttctaaccgcagctttttcctgtgcaaattcaggattttatggatcggtaagagcactgtatggtctctcactggaagggatggcaccgaaaattttttcgagactaaacaaacaatgcacgccaatgtatgccacactctttactcttctcatgtgctgggcagttctgagcatgtggtggttctccaatggtgagggtgaactgtatctctggctcttatcagtatcagcatttaccggtgctatctgctggatatctatctgttattctcaagtggtattcagaaggcgtgtttacgaacgaggctattcaaagcaggatatcaaagccccagctccattatctccatggttccccttaatgatcggtgttattcttgagatatttgccctggtcatccttgcattcaatgaggatctaagaggctccctctatctttctgtcccggcagtggctgttcccatgctcatctattacatagggagaaaaaccgggacgataagcggcataaaaatccgtcatgaagatgaaaaaccctttgaagaactcttcccggaaaaacataaaccctcataatctccatttttgatacatagatgcaaccagtacagaaggtgccatatgaggaccatgtttcaataaagactggtctcccgccaggtatcccgatttacatagggaaacatgaaccggaagttaccaaagtttctgctctgatatattctgctgatggatttaatatttttccagagatacaagcatctgacatttcggaaattcgatccggatatgggatctgttgggttcacatttcaggactgaaagatattgataaaataaatcagatcttgtccgatgcaatccttcatccattaattgctgaagatgtctttaataccaagggaagggcgaaggttgaagattttggtgatacactttttataattcttgatattattctcagtaatggtacagaactgcaatcacggaagataaacatcattacgaaagaaaaactgctaatatcaatatcagaaaccagcaacccttttgagaatattaaaacccgcatttctcttccaaatggaaaattcagaacacatgacgtcgattacctgatgtattcaattatcgactccgttgtcgatacctatttttttggtctcgaaagaatcgaggatttgtcagaaaaactagaagaacgggtcgttcatgatccaaattcggatatcatcatagaaattcagtcatttcgacatacactcataaaattcaagagacaggtctggtcacttcgggatgttatcatgcacctggaacgatccgattctgatttcctgacagattctaccaggatattcatgagagatgtatatgatcatgtgataaaaatttctgaagatcttgatattcaccgagaaatggctgaaggaatcatggaaatatatctctcctcagtatcaaaccgtaccaatgagatagtccgtgttttgactgtaattgcagttatctttatcccactgacctttcttaccggagtctatggaatgaatttctcatatcttccgggtattgatcaccctgccggacctataatcatttttggtataatgatcctcattacaaccagtatggcagcgattttcagatggaaaaaatggatttaatcaaatacctgaattgcatcacgcaactttttcgttgaaacaccatacggaccctttacagtcagagatatggtgtatgttcctggcttgatatatgaatgaaccggattctgttcaatagaattactgccatcaccaaagttccatgaccatgattcaatcgttcctgaagaacggtcttcacaggtgatggacagaggagtttttccgctctttttgttgatagcaaaatcagctattggtttggatgtctccgataaatctaaatcattcatatcagattgattctttttcttgctaatgtctgaagagaatatggatggatttatccggtcagattttgaataggtcggtcccactgtcacgacttgatcagctgaactgattcctgacggtccatacaccgtgagcttgacaatatatgaaccaggtgcggtataccggtgagatggatgtctgaattccgaaaccgctccatctccaaactcccagaggtaccgatttatacttcctgtagattcatcggtgcactgtacagagaggggagctattccttctgatggtttcagactaaaaccagcaacaaggggttcaggttcaggtgaaactacaatatatccctttctgctgacctgatttgttccggacggtccggaaactgtcaatgatactgaatagacaccggtcttattgaattcatgagtcgggtttctttcagtggagatctctccatctccaaagtcccatttccagtcagatacctttcccagtgactggtcagtaaaccggaccgttaatggtgcatatccggttcttttatcagttctgaatcgtgcttgtggtggagtaagagaggtacctactgtaatataatcttctcttacttctgtcgaggagccatcaggaccatgaacctgaacaccgacggtatagatacctggatgggtgtaggtatggctaaccgtctcaccagttccatttgatgaatctccaaagttccaaatccaatcagatattgtaccggtagattcacttctaaatgtaacatgcaatggtgccgggcctgataccgggtcagcagagaatgatgcaattgggattgatatggattctgtcacattgataagattggtattgattatctcctgtgtatttccttcaaattcgcgagtcaggtgaacagaatagatccctggttttgtataggtatgagtaacttctgattcattcgaggtcattccatccccgaatttccagagataggttccattttcctttacccatgatgaactaaaatcaacggtaagaggtgcgggacctgtcttctctgatactataatttctggaattagtatttcagatctttctttcgtatcagtacctctgcctacctcatatttcgatacattagtaagggtttctgtcttatttatcgggatcagtatatccggctctattttttctgttccattgatacgtgcactctgattatctgaagactcattaggaggaacattcagactagtacgatttggaacaaccattggttcagaaataaccgggacaactattagtgattgattcgattgattcgactcattagaaataataaaaggctcctcacctcttgtttgaatcggtgaaatattgtcagctttcgattcaggaattacaggaactggttccttaaccaaaaccggccggggagcagaatatcggttctctccaccaggtcctttgacattgagtgaaacaaggtatgaaccggtggcattgtaggtatgaacagcatcttgtgtttttgcagacgatccatcaccaaagtcccagatccattcagtaatctcaccgagtgactgatcggtgaacctgactgaatacggggcatagccttctgtgccgttacttgagaaattcgcaaccggtggcgggattggcattgtaacattcacaaattcattcttggtaatagtacgggattgtccctggaaatcctgaattgtgagactcacagtatagacaccaggcattgcataggtatgtacaggcgatggttcattggaggtattaccgtctccaaaactccattgcgaactcatcacattgccgacatccgattttccaaatgtgactgtgagaggagcagttcctttcgcaggttcagcattgatgattaattcaggggatagtgcagatcccagaacagatatcaggtctgtcctttccacactgtcattcccacccggtccgtccgcattcagaagaacggtgtagataccaggttttgtataggtatgctcaggattcttttcattggaagtaaacccatccccaaatatccaggtcaggttttcgacatcaccggttgttttatcagtaaatgcaacggtaagtggcgcatctcctgaaattggaagggcagagaaagaagcatggactggttcaatagatttttcagcaatgattaaattctcttttacaagaacatctgtaccatccggaccagttacaccaagttttacatgatatgttccagggttggtatacacgtgggcagggttttgttcggttgatgaaattccatcaccaaagtcccagtcccatgcagtaattatacccgttgactcatcatggaatgatacatccaggggaacatgtccctgaaccggatcagcagagaattttgctttgagaactggaggggcttctagcacggtaataactgaattttcacgcaattcatctttcccgccaggtcccctgacggtcagcgtaatggaatactggccgggcaaaatataggtatgagtgggatttttacctctgattaccttaccatcgccaaaatcccagatccattcattgatttcaccttcagactgatcagtacatactatggcaaagggagcagtcccttctgtgctgcttatagagaaatctgcaaccggagcttttggaggtgaaagtacagatataaccgaagtttttacaattccttcttcagagccggcataatgcagagtaaggcttaccgggtaatccccgggtttgtcaaatatatgagtaggagccggttcagtagagtttgaaccatcgccaaagtcccagtatcttgtttcatactctccggttgatgtgtcggtaaattgaaccgaaagtggaacatcgcctgacgcaggtgtacatacaaagttcacagaaggttcagatacggaagcaacaggttcagatgtctcatgtattgcggctgttgtaattggttcaatgctttctcctgtaacttcagtatcttcagatgattttgaaatttggttgatggtatcagttggtaagacaatttcttcaggttctggaagtacttgttcggactcaacagatattgggttacgcgtatcttcaggagcaggagaaggaactgattcagtaagaactgggatattatcagttataggagttggcagtactggttcaggaacaggagaaaaagaagaaacaggtaccggagtgggagttgttggggccagggtcggtggcggaagatcagggtgaactataatatatgatggtctggtcagaatatcatcattatgggtaccggtcactttgagagatacttcatatgttccaggtttttcatatacatgggttgggttttcaagttctgaaaataatccatctccaaatgaccattccctcgagactatagttccggaagtctgttcgttaaacttgacctgcagaggagtggttccttcagttggttcagcagtaaatgatgacaccaccggagtgattacctgaataattccggtttttgtaattgtatcagtacttccatcaccttcaatgtgtaatgagacatcatacgttccatctgtctggtaaatatgtattggagattttgctgcagatgtggtcccatcaccaaagtcccataaccaggaagataccagtcctgttgatagatcagtgaaactgaccttcagaggcgaaagaccaaccgcatcagccactgaaaaatcagcatggatcgatgatactgcaggaacgggtgcaggagttgcaggtacagtatgttctgatactggttctggcacattcagaacagtcaccagatcttcaggctccgtgatctctccgttctgaacgacaatagaagacttggtatctaaggtgcgctctgtaagaaccggctcagacgatgagactgattctgaatcaggttctgaaaccgaaatatatccaattcttgtctttttatctgaaccggcagttcctgaaacagtcaacgaaaccgaatatacaccgggtgaaaaatacgtatgaaccggattttgttctgatgaactctcaccatcaccaaatgaccattcatagtggtcgcgtattccagtagagagatcggtaaaggagaccgtaaaaggaacatttccttcttgcttatcagcagtaaaatctgctgtaatggttgtatgcgcattctgcacactaattggagggaagtctccagtggatgtaccaatgcacaggatcaaagataacagaattaccccgactactcctgatttaatacataatttcatatgcccaacccatcgtgatataaccatatgagtttttatatataaaaattattatcttaaaaatgaacgccgaaggggagatttgaactcccgaggtgttaccaccagtggttttcgagaccaccgccttcccggactagactacctcggcacagatgctttaacatgttatcatttccgtttgataataatatcgtcatcaaaaagatatcctatgtcactatggaatcatgaagtcccatttttttaccaccttacctagactttgcccggcgattttgcccggcagatcactactcttatagagaaatatgttccagaactattggtatcaccgataccagtccggcccggtcgatcacccctgccatcctgagggtcggacactactattctgtaaaggacatatgtccatgcataaaagagataatctttttggatatagtagtctcataatgtatcaggcagaatattcactgcaataatatgatggtggatgtacatggggctatttcgatcacatgatgataagcagaatggtgaaaaaatttcctggtcggttccctttcctcctgatttacttgcacgtcttcggggtttttctgccgtttctatttcaaaagcttcaggaatgtatcttgaggatgtttttgaaattctgaaaggttctcgttccagaacctctcctgaagtaattgaaatgcttgaaaacgtattaaagaaactggaagaggatgatcagcggctggaaaaagaggctgcaaagattaattttatgatcaaagggtttgatgtactcgaacaaaagaagcaaaaaagacagctgaacagacttcccgaaaccggatattatctggaagaataaaaaagattattccattggttctggctttccgcctttaccagactgggataccatcatatcatcaacccgaagcagcatctctacagcttcttctgagctctgtattgcctgcctcttgcatctgattggttcaataactccttctttctgcatatccaccagtttaccagtgtacacattcagtccgaagttcttcttcccttctgcatgtgccttctttaactctaccagtttatcgattggattataaccggaattttccgcaagggtgattggtatagcagcgaatgcatctgcatatgcttcgatggcgatctgctcacgtccaccgacattaacagcatagtcacgaaggcggacggtaagttcactctcaactgctcctccacctggcacaaacagtccgtcttccattgcatccatgactacccgggttgcatcgacaacagcacgttctagttcatcaaccaggtaataggtagaaccacgaagaagaatagtcacagtctttgggttctttgcaccagttatgactaccatatctgcgtcatcaagttgctctgccttctctgcaacaccaaggtcactctttttcaggtcttcagcttttgtaacaattgttgcgccaagtgagcgggctgcaaatttcagatctgcttccggaacatcttcaatggcaagaattcctgcttttgcaaggtagaactgggcagcatctgcaattcctttctggcagaggagaacatttgctccggtttttgccacagcatctgccatctcctttaatgcactccgctcctgttctgcaaatgcttcgacctgctcagtgcttgagatcttgatctttgatttgacctctgtctttttgatctcaagctccttctgaacaattgcaacctttgcattgattacgcgttttggcatctcctggttaacgcgggtcttgtcaataacgcagcccatgataagttctgcatcatccatggttccgccggtgtgctttttgatcttaacatcatcctcattcaccgttaccttgtttccatccttggtggcaactttcattaccgcttcaacagagatatcactaattttatccttgacgtcctcaattgatttgccggtaattgcagtctgaacaatcttcttcatgacgtccttattgtatgcgtcagtcttagatgccattgactgcagaatttcaagagccttcagcattcccatccggtatccacggcagatgacggttggatggatcttcttgttaagcagggactctgcctgttccataagtgagcctacaagaatgacagcagtggtcgtcccgtctcccacctcttcgtcctgggttctagagacttcaatgaccatctttgccccaggatgctggacagagatctcatcaagaatcgtaataccatcattggtgatggtgacatctccggtcccatcaatgagcatcttatccattccacgtggacctaaggtggaccgaaccgcctcagcaagtgcttttgctgctgctatattggagcgctgggcttcatatccctgtgtacgctcgacattctgtttcagaatgattaccggttgttgagcaagcatagaatatcctccgtttcaatacaggtggatttaaagttctatataaaaattgtgagttcgtgtctcataatgaaaccggttagtctattcgggagaccttaaacagactgtaaaccggaacgccgtcaatgtctcgaatgccgcgcttatcaaagagaacacaacatgctacaggaaccgcaccatgccttttgatatagttaattacttcctgcaaggttttgccggaggtgataacatcatccaccactactattctctctccggcatgaatgtcaaaattaccgctcatggatccgattggttcatctcctccggcatgtttggcaggatgataaataccaattcgtacaccctctgttactgccatcagggttgctagcggaattccggatatggctattcccacatacacctggggaacgggtccttcagggtttttcagatgaagccgtgagaggagcatctgggcactctccaccaaaagctgagattcgccggatacggcagtccaatctatatgtacatctttcggggtagccgctcctttctcctgagtcagaagccaggtcacggtctccatagagagggacaattcatcagcaatctgcccggggctgtgaccttcactccgcaggtgccgtgctttttgtatcaactcatccagggtagacatctgaacagacattttcgtcaatctatttattttttcgtcttacctgcaaaccacatatcggacagatagagtcagcaggcatgacatcataatacttcccacaccccgagcaccgaagtttccatatccgcatttctggcttcttctgcatcatgggatggacatcgatattcagatattgtgcggtattctggagagcaaaatcatctgtacaaattactccatggacctcgaaagcaagagcaagaagatcagtatctgtttcagataagacatatccatctccggatttcgtggcggcattccgaacagtcatgagagatttctgatccggctctgatatgatcagtccttgtgagagtaatacttcaagtcttgctttccccttaagatcctttagttcggcgataacccgtggaacagtcattatctttccggtaacagggatggaaataaaaaatgcggatgtatccaatatcaatgccggaagagaatcgtttgtcatcaggtaaaccaaaaatcagagatattctgccagtacctttgctgctgaataggtactacaggctcgttcaaccgtatcactgcaggagattgaagcaattccagcactgatgagtcgcgtataggcaccagaagccagaacaccgtgaattcctacggtatgaatcgaccgagctccctgttcatacagcatcattgcagcggttgcctgagttcctccggtcgagataatatcatcaagaatgaccacatcacgccctgctaccggcactgacttaggttctatcctgacctgttccccggatatacgggtcttctggagataatcacaatcccaattcccatgagaagcaacatcctgtccaagatgaagcgctccctcatcaggacttaagatgagtggattttcaagcgataacgtatcaatatacgctgctgccggagtggaaagagagacatcagttgcttcagtatggaaataattcaatactgatttttcatggatatttaccgtatagactcgtgatacaccaattccaaggatgtgagctatcgctcgtgcagagaggggttcaccagaattgaattgcttgtcctgtctggcatatcccatataaggaatgatgagtgaaatgtcggacccggaataaatatcttttaacagaagcagctcgaccagatcatcactagtaagaatgcttccacatataatcactttctctgcgggctgctctgcacgcacatagatctctccatcaggaaatttctgccatctggtatcaattaccggaatattcaatgcagttgcgagccggccggcaagaacctgagaccgttgcgtactgacaaccttcataatctcattaagatttgctgaaagtacttaaacaattgtccatgaaattattaccacgaacggttttgcaggtgtcgatattataatgaatcgggtgaacgaaccatcggagcgagaaattcaaccagatactccggaaactaccaaagtatgggatgttccgggtatagaaccagtggatacactggatgatgaaacagatgcgcctgttgtaaagactgatacttcagctgcatctgaagagaaagaaccccagataccagtagatgatggctcgtcacggtcggttactgtccctgaaaaactcattgatcaggtaatcggacaggaacatgcggtagaggtaatcagaaaagcagcaatccagcgcagacatgtcatgatgatcgggactccgggtacaggtaagtccatgctggcaaaggcaatggctgagctgcttccaaaggaagagatgcaggatattcttgcatatccaaactctgacgatcaaaatgaacctatcatcagaactgtgaaatccggccgtggcaaagagattgtcactgctcataaagcagaagcgaaaaagaagatacagttcagaaataccctcatcatgatcctgatgatcggtatcatcgggtatgcttttatcacctaccagtggctgatgggtattattgctgcagcatttatcttcatggctctgcggtatgccactcccagggaagaacagatggtccctaaacttctggtctccaatgataagacaacaacagcaccttttgtcgatgcgaccggatcacatgccggtgctcttctcggagatgtccgccatgatcccttccagtctggaggacttgagactcctgcacatgaccgggttgaggcaggggccattcatcgtgcacataagggagttctctttattgatgaaattaataccctgggtcttccttcacaacagagtctcctgaccgcaatgcaggaaggacagttcgcaatcaccggtcagagtgaacgttcatcaggagcaatggtcaggactgaaccagtcccatgtgattttgtcatggtcgcagcaggtaatcttgacgctattgaagggatgcatccggccctgagatcccgtatcagaggaaacggttatgagatctatatggaagataccatgcccgatactcctgaaaaccgggaaaaatttatcagatttatcgcgcaggagatcaaaaatgatggtatgatccctcactttgaccggactgccattgatgaagtcatccatgaagccaaacgacgttcaaaccggaaaggctacctgaccctgaaacttcgggacatggggggtcttatcagggttgccggtgatcttgcacgacaggagggtgcagagcttacaaccagacgccatgttcttgaagccaagaaaactgcccgttccattgaagatcagatatccggtcagatgatacgaagaacacgtgaatatgaacttgctgtcgttgaagggactgagatcggacgggtgaacggtcttgcagtcatggggagtgatgctggatccgtcctcccgattatggctgcaattactccggcacaaggtgatggtggtaacatcatcgcaacaggacttcttaaagaaattgcacaggagtcaatcaagaacgtaggagccatcctgaagagatttacaggaaaagatattagaaatattgatattcatatccagtttatcggaacataccagggggtggagggtgattctgcttcaattacggttgccacagcagctatcagtgcgctagaatcaatcccggtcagacaagacatcgcaatgaccgggtccctctcagtcagaggagatgtccttccggtcggaggcgtcacctacaagattgaagcagcagcacgggcaggtatcaggacagtcctcataccaaaggcaaatcttggtgatgttctcattgaggatgaatttttatcaaccattgagatcattccggtagaaaagatagatgaggtactcaagattgccctggttcctgacaaccgtgagatgttccttgataagctgaaaacaatcgcatggtccacaacccgttcgattctgggaactgatatttctgcaccccggacggtagtctgatgtctctcccgtaccgttactacgatgtccgcagggttaccggagaggttacccagattgacgtggacaatggaagagtggaacaagcaggctcctcattttttgataaagcagtcatcagggttcttggagaaaagggatggggaatactctccgtatctggcgaagaggctgagtttgaaacccttccggagtccttcattcaggaagcatatgctgcatcacaggttacgaacatacatatcccgattcaggagacaccatctcacctccatgttgtacctgcgatgaaagaaaatccggcagacgtaagtcttgatgagaaagttactatcctgcttgatatgtataaggcaacgaacgggcaggatattgtcagccgtcggattaactatatcgaaaaagatgaaacggtttcattctccgattgtcttggtcatgcatacacctatcacctgtgcagatgcggtttttcagtccttgctgtcgcatcacgtgcaggcattgtccagatgggatacgaacgggatcataccatatccggcctgaacatacggcatcgacaggatcttgccagagaagcaacagaacgcgcccaaaaactccttgatgcaaaaccggcgaaaggaggagtgatgagggtagttctggatccagaacttgccggggtttttgctcatgaagcagtcggtcatgcctcagaaggagacctggtgaaagagggaagctccattttgaaaggaaagatcaacgaacagattggatcaacactcctcacgatagttgatgatccatcactcccgcaatttggtttttgtccggtggatgacgaaggaacagagacaaaacggacagagataatcaaaaatgggatattgtctgcatatcttcattccaaagagacacttgcatccgtaggtgacggggttgcaggtcattgccgggggatgccgggtgttgagccgattgtcaggatgagtaatacctttattgaaaacggtgattctacctatgatgagatcatctccgaatgcagatcaggaatcctactcaagggatcacggggaggtcaggtagaccccggacgggggatgttccagtttaatgctgagtatggatttctgattgaaaacggagaatgcaccactatggttcgtgatgtttccctgtccggagagatattacagaccctgcataccatctcccttatcggtaatgatctggcgctgcatccgggatattgtggtaaaggtggacagacagttccggttaccgatggggcgccacatcttctgcttgacaatgcagtagtaggagggtgtgaaattgattgaagatattctccgggctgcaaaacaggttgctgatgaggctgaggttttctatgctcatagtgaatcaattgctgcagatctgaaacgggatagtattgccatcggaagtaaatccaaaggatccggcattatcatccggattattaaagatggaaagattggagtatcctgtacagataatccaaagacatggaagaactgtcttgaagcagcatgtgccagtgccaggttttctgatcctcttccctggaaagggcttccagggcctgaagaagtaaaccagaaacccctcgcccttgacaaacggataactaccgatccggccctcgttattgatcttatcaaccggctgaagacaggtgctgaggcatatactgcagatatcacctcaggatcagcatcggtcgctatatcagaacataccattgcaaatagtaatggtttattttatagtactaccggaacacaggttcatgtcagtctggagatgattgccggtcagtccacaggctatgaatctgatacggcatggaaccttgacataatagatcctgaaaaaaccgggaaagaagccgccttttttgcagcccgtggtcagggaggagaagagatagaaacagggatttacgacgtggttctctcaccaatggcaatttcccagctccttgatgctgcagtcatccctgcactttcaggaagaaatgttcataccggacgttcggtttttgccggaaaaatgggagagcatgttgcaggggatacgatttctctgattgatgatccaatggactcacgaggggttgccaactgtgcatgggatggtgaaggaatgcctgtccggaagattccattcatagagaacggtattcttcgatcatttgcctatgacttgagaacagcataccggtacggggaaaatcctacagccagtgctgttcggaccggtcaatccggtgctccggctatcggaaaccataatctcatactgaaaggacccgaatatgatattctttctgataaatctgtatatgtacatgaccttatcggtgcacatactgcaaaccccatgtcaggcgatttctcagtagaactctcatcacctttctttgcatatgatggagaacttcaggagccaattaggaccgggatgatctccggaaatatctttgatatcctccataaaattcaggggtgtagcacggatacccgaacacttggttcaactattgtgccttctgtcagattatcaggcatttctgtcatcgggagaggataaatgacatccgatgcactaaaggcagatcccaaccggcttataaaaattatcgcatctttatcaagtacccgtgaattactctcaccagaggttaccaaggccgatgcattggaaatcagactggatttaattaccgagccgatcgatgatgcattacactcacttcggacctcctttcagggcccgatggtactcactgtccggagtagtgatgaaggaggggcatatgcaggagggtcggcagggctgtggaagaaattagaaccttatatcggacttgtagatattattgatctggaaatcagatttaaggaccatgccccacaggtgaaagagcacaataaagccataatagcgtcctgccaccagaaccggatgcctgatgatgatgaaatgcaagctcttatagaagagcttcattcttttggcgatattgtaaaaattgctgtacagcctcagacaaaagaagatgtcatcagacttctgaaaattactgctgcttgtccctaccctattattatgagtgtaaccggaactgtatatcgatatgccaggcctctgctctgtctttttggctctctatatacctattgttacatccatagcgagacttcacccggccaatatagtcttcgtgaaatgcaacttcttgcccatctgctcagccctggatttgtcgatccctggtttgaaggaagaccggtcaggtcaggagatgcatctggctattatgaacgggctgaacagtataggaaacatctcgaattttaatgaattcactttttcatgaggacgacacaccggatactacttcgtatctggtatgacccggcatgcgatttctcaaaagtagtcattggatatctgaaccggggggccagtggaaattgttctacaatacatggctctgaagttacaagacttgaaaaccggtatattgttataaaccatcattttgcatatgaggaagaggtgtacatcccgtaccaccggatctggtggataacctatgatagccggatgatctggtctcgtactcatagatagatatacagactctgattgaataacttgcaatatcctttttcagaccctccagttaaatctgaatcttcctcaaacctgataaggccgcacacaaatatagtacatatacgggatgcgatagggatctgaaatgcaaataacttctttcctgttcatcctggtatgtgcatgtattattcttatctctcacacgtgtgcatatcaggatgagaacatggaaaatactcatccatctgacctcatccaattaaaagaacttcaggatgaggtcattattggtgataaaatcacacttacgggccagattgaccggtcattattcggaacacaaccatctgatgtaataatcctcattactgcgccttctggttcacatgccgacaccttcatgctggcaaaacctacatcaaacgggactttcagatataaccagatagctgatgttggcggggactggggttttgaagcattgtataccggaatatacagtgaaaaagtttcggttcttgcagttccgggtaatgaacctaaaaagactgcattaacattaagcggctggcctacgtttccgaaaaccggtgattatgtcacttttaaaggtcggttaacagacagtgaagggaaaggcattccacataaagagatcttgtacaggcttgcttcaagcccggtcggatgtcttggtggatgcgcatttggtggaatgcttgaatggagggaagcaggatctgttacaacagacctcagcggagaatattcattcagtcttccggttgttgagagtggaactgtgcagattgaagcggtattttccggtgatgaaggatatagtgcaacctcctcaagagtactgaaaattacggtatacgaataaattattttttatattgttcaggattcttatcaaaagtatccttacatcctttattacagaaataataggtttttccttcataggtagatttgaattgggcagtattcggatccactgacatgccacatatcggatcaatttctttattcatgtacatacctgatttcatttcctgcataagagccgggggtgtatactgttttaaaagaagagaaagactgatgaccgtaaccgatgagaatgccatggcaagagccccatattcaggtctgaacgtgattacaggataaagaattccggccgcaagtgggatgagaacaatattatacgcaaaagcccagaataaattcaacctgattcttcccattactttcctagctaactggagagctgctggtatatgaatgagtgaatccctaaccagaaccacatcagcactttcaatagcgatatctgtgccagaaccgattgcaattccggtatccgcccgtgcaagagcaggtgcatcattgattccatccccgataaatgccaccacatttccattgttttgaatctgaattacctgatcttccttcccttcaggtaatacccgggcaaatatatcggtaattcccaccatagacgcgactgcatcggctgtaatctgattatcaccggtaaccataccggaccggatacccatctctttcaggagcctgacagcccgttcagcttctggctttacctgatccgcaatagagataagacccagaatttggtcgtcacgtgagatgagaattgttgttttcccttctctttcccgccgggttaccaactcttcttcgttagatacaaatgagatcccttcggatacgatgaaatcacgggttcccagtcggaccacccctccggatattgttcctgaaaggccgctcccggaaatattctgaaatgatgtgacctctgcaggttcaatcccctcgtggtgtgcttttgcgaggatggcagaacttatcggatggtcggagagaatttcaagagatgcagccatggacaagaggagtctgggattaccgatgaatgaatccacatcggtgacaactggttttcccttggtgatggttcccgtcttatcaaaaagagccacggtaattttatcagctatttctaaaaccgacccattcctgataagtataccaagttcggccccacgcccgattccaaccgttaccgcagtcggtgttgcaagaccgagagcacacgggcacgctacaacaagaactgcaatcagggtctgaagggagaaccgaagatccattcctctaataccataccaatagagaaatgcaagaaaagcaataagaagaacaacaggaataaaccaggtaacagcataatcagcaagtctctggacaggagggcgggacccctgggcctcttcaaccagtctgataatccgggcaagcatcgtgtcagagccaactctcgtagctttataaataaatgccccgtttgttaccagagtgcctccgatgacctcctgccctggttcgcgcaaaacagccagaggttctccggttaccatagactcatcaacataacttgaacctgataccacgatcccatctacaggaatccttcctcccggtctcatacgaatgatatctccagggattacctcctgaacaggaatgtctatctcaaccccatcacgaataaccgacgcagagtcagcctgcaatccaatcaatgaggttattgctgatgatgtccgcccttttgcccgcgcttcaagataccggccaagagataaaaacgcggtaagcataagtgcagtctcatagaacaacatattcatatcaagaataatggaaaatgttccgagaacacttgcaagatatgcaaccgatattcccatcgcatacatgacatccatattcagggttttattccgaagagcaccaaaagcagcacgaaagataggagtaccaagccagaacagaaccggagttgtaataaggaactgaacatatgacatcagatgcatatcatgatccggaatatacatcatgcccataagaaccagagagagactaaaaccaatgatgattttaaaaaactgcttttttaactgtatttccagtaatttttcactctcatctatctcatcacggtcagttccgagaaactgatatccggcattatcaatgacatccctgattttttttatatctacaagagaaggattataagtgatatatgcccgctcattcgacagattcacatcggctgatatcacaccatctaaggtctgcagggctttctgaactgtctgaacgcaggaggcacaggtcattcctccaacctttataaccgctttttcaaatttgaccgaaaacccactcttttccacagccccggtcagatctgaaacggatacctgtgaaggatcatacaatacccgtgccttccctgttgcaaggtttacttttgactccatcacacccggtgttgatgaaagactcttttcaaccgtaactgcacaggtggcacaatgcattccggatatctccaattcaatctcttttttattctcctctgccatacaggaacctctttttagaaccatctttttctatggagataaatgaaactcaaaaactcattttggataataaaaccagatgataatatatgatcctttgtgcagcacagatatcaccctgttggaatgatccggaatccggattaaaaaagatgagacaatatgctgctgaggcagtagaaggagatgctgagttgattgcatttccagagcagatactaaccggttgggatccccatgatacatcatatacaacagaagaaacaggagcactcgtagatcagatgcgtgagattgcacaagaggtgagtatcggattaattggatcatatcgggaaaaaggtgaagaaaaccctttaaacacctgtattgctatcggacctgatgggcggacacttgcgaaatattccaagattcatcttttttctccagctggagaagatcttcattactcagccggcaggacactgggatcatgtaccgtgaactcctgcacaattggtcttgccatatgctatgatctcagattttcacaactctttcaagcgtaccggaataaaggggtcctccttatgattgtcccttcagcctggccatcctcccggatgaaacattttaatcttttcacaacaagtagagcggcggaatttcagacctttgtggcttctgtgaataccgtcggtatcactcctgtcgatacctatacaggagggacatgtattgccggaccggatggaactatcagggcacggggaagtgatctggaagaattaattttttatgatattcacgaagaagaagcactcactatgagaaaaaaattcccggttcatcaggattatgagaaggttgactatactgaattacttgccagataaaaaagggtttacaatattaaaatcagttcactcactgattcatcatattcatcatcgcctgggaacctgacctgaataaaggtggtcgtcgatcctccactggcggtaaatttaaaaaagcctttctcatctgtggtcgagataccaagaatagaaaagtcgcttcttgttcccacccggtcggatgcttcacaaattacctttttccctgacagtggggctccgttctcacccatcagttgtccgccgatggagaccgcctgaccagggaatggattggaaggggatgcctttgcggtaatttttgtctttgatttggctacctgtgggataattccggtctttacctttggctcttttgagatatgacctgatacaatctcacttactgttccttcaaactgggaatttccattatatctgactctgagatattcaggcggtgatgctgccggtcggaaaaatgaatatgccccttcaatatcagtagttgccactgccagaaattcatattcactttccggatcattttcttccaatcgttcaagggatactttcttattacccataaccgtaccttctgcatcagtcaggatccctttcacggtgaatgggagattttcacccggatcagcaggatcggtcccaattgaaagatgggtcactaccttatcagcaaaaacaccagtcccccacccacaaaaaacaagtgcgataagggttgtcaggaccaccagagagaaactgagtgcacgttgtgactgcactggtgaacacgtcatacccaatatctggtaccgcttccattaacaggattcccatcaaaagggattatataagtttaaccacatcgtgttttggctccattgcttcaccggaacgaagcatcgcagtaagctggcgttccacctcatcacggtcaaatccctgctgacggacgatttctatcacatcaggtttatgagctctgccattctcatctgcaatatcccgtattgcctgcttaatatttctgataagatcacgtttactcttagaaacaccggttgcgagcatatcaatatcaaacgaaccgcttgatggatcatatgctacctgcctcagacaagtatcgataatggtaatgacccgatctgcatcactcttttctatgacagaagagagtctgattctggctgatgcctctgccagccggacaattgcctcaagctgccgggcagtaaccgggaccggtttgttcgcatccgcaaggtcacggagtttcatgtagtatgcaatcaatgtttcgcgtgcttcgtctgagagccgggggaagcagcttcgtttcgcataagccacatactttctgaacattgccggatcgatctccggagtgaccggttttagctgttcggtgatatactcttcatccacaccggggattggttcacggttgtgttgtgcgataagttctccaacactatgagccttgatgatatgctccgctattgccagatcacgctcatgttcaggtttgtctgttaggacaaagaggagatcaaatcgagacagcagagaagggggcatattgatctgatcccctatcggaacaaaatcatcaaaccttccatacttggggtttgctgcaccgagaagagcgcatcgggattttaacgttgccgtaataccagcctttgcaacagaaatagactgctgttccatagcttcatgaagagcgctccggtcatgcttatccatcttgtccatctcatcaacgcaggccacacccatatctgccaggaccagagcacctgcttcaagggtccatcgaccgtctccaaactcatctttaactgcagtggcagtaagaccggctgatgttgttgactgtccggaggtgtatattgcccggggagagagacggacaacatacctgagcatctgggactttgcaattccaggatcaccaattaagaggacgtgaatatcaccgcgaagcctgctcccatccggcatctcctttgcaattcctccaaagagctgaagagcaattgcatccttgacatcatccactccatagattgtaggagcaatggagtgtgcaatcttccgatagatatttggatctttggaaagggcgaggatctctttttcatcctcctcactgatgttcacctcttcaaactctttttcagctacttcaatagagttacattccacatagatatcaaatatcgtggactttgttccgtacgaatttcgttgaatcgagcggaggattccattgacaactatccggtcaccaggtgcagaagtaccacagatatcatcaatcacatcaagatctatggtctgcggttgttcaccgccacgaagtccctcaggggactcctgaattcgaagtttttgagagtctacaaatcgtgaaaaccggggaatgagctcaagcttcttctgagtacatccatctgcctgacacccgtccggctctacaaagggaccatatgactgagctttgacggtacgatgaccggcaggacatcggaatacagccagagtgattcgaggtcttacttcggtcgttttccggagaattccctcaacactaatgaacttgccgatatgatcagaacggatttccctgattgcaatcttcctggggagattgataaatctgacattaatatctggctgctcatctttctttctggtttttacaagccgatgggttcggatagcatctttgacatctcctattactttcccagggttttccaaaagttcatcagcaagttcagtcccggtcttaccaaaactctcaatatcgcgataatttatatagagcgagcgtttgtaaggatattcacgggataattcatcgagttcttttttatatcgtgtcttgagaaaccggtgccagtctgcatcacggtctgtaatctcaaccgattctacatcttttcctggtaccatgaagatcagaattacaatgcattttgttcatgaaatgaggatatgtatttgatccacaagattaagagagttttcgaaaatgaacatgaggaacgctcagaacaaaacaggccccttctccctgttttccattttcaatgattgaaatatcggtaattgacaggatttcccgaacgaggaatagtccaagcccggtattttttccataaccgcgcccgaaaatctgttctttatccccatcagcaacgcccgctccatcatcagcaatttttagttccaaaataccctctttctcacatgcactcatatgaatagtggtaacgtgttcaccatgccgaagtgcattatcaaatagattatagaaaaccttttcaatgagggggtcaacaaaaatttcgtactgattcacatccggatcaacgattactgcgatctgggtaaatgttgaactcattttatgaatcaaatcttcaagccgaatccagaccgcaccttttacccccagttcttcatacagtctggtaaactcgatctgggcagataatctggagagcagctgaccttcacgttccagatattcctgaaattgaggatccggactgtccattttcgcaagttcattatatgaaagaagagccatcatggtatttttcatatcgtgacgggtgatggatgagagaagcccgagttttttatttgcctgtgagagcgataactcaacacgtttacgctctgatatctcatttttcaaatcttcattgatcctgagaagttcattattcgcatcgctcagctgatcatttacagaagcaagtctgtctttcgcctcattcaactcattatttttagaaattgcaatctcatatgtagaaagaaggatattcagaatcttctgacggttcgaagtaataacatgagtacttcctgaaaaaaataccgatactccaggttcaacagattcatcttgatggatggtcctatttgccagaatgaccttaatacggtcaagaagatatgcggcttcatatggcttaataataaaattatctgctccacattcaagtccggaaagcacatccctgggatcaaagagctgggttaccaaaattaccgggatgttcctggtctctggatcagcctttaatgtcttacataattcatacccattcatttcaggcatcatgacatcagtcaggaccagagtcgggagttccttttgtatctcctccagcgcttgtcggccgttatatgccactctgactttatatcctgctttatcaagcagatgacgtaatatttcagcctgagtcttactatcctcagcaatgagaattgaaaccgtttcattttgaatatcagccatgaagacctcctttttggacaggcggagattctgatatggaatcagtatcaggcaggaagacctgaaatgttgagccatccccaggtccagggctctttactgatactgttcctccgtataatgcaatgatacgcttcactattgcaagaccaagaccatgaactgaatggtcatgtcgtgattcatcggctttataaaaatcatcaaaaaccctgccaatctgatcatgtgtaagtcctattccggtatcctgaatactgagtacctgcttttttgcctcatgttcgcaggtaagggtaatacttcccatatctttattatacatgattgcattcgagaccaggttttccataactgtcattgcatgaaaatgagacatccggatacaagtcctgggacggataaaattttttaccgttatccctttttgttccagcagatatgagtgatttcctaatacttcaagtgagatcaaatgaatatctgcactggttttcatgtcagagaatgaatcaagggtgatgtgtgacagtttgagaatccggtcaaccagatgcttcaaaacggtaacatctttcaccaggagagaaagaatctcttttttttcttcatctgattctttctgatataaatacggtaaaaatgcgtacaacggagtcaggggggtttttaaatcatgaccaatccgggttatgaggtctgttctctgcattagaagatgttcaacaatctcgttggtcactgataatgcctgtgttctttcttctaccagctcttcgagatgtgaggtgaaatcattcagttccctggtcgtttgttccagttctgaattttttaatgctgcagtctgataaattgacatgaggatgcagagcagatcctcccgtgatgaacttatgagatactcatgcccttcataaacaaatggtatcctatcagaatcggacctgtttgaagcgggatgattcggtctatctgcaacaagagatatttccctgatcaactgctcccttctgaccggttttataatgaaattattagcaccacaacaaagacctctgataatatcagtcggatcggataactgagtgacaaaaataatagggatatgagagaatcgggcatcttttctgagcagatgacagaaggtatatccatccatccccggcatgacaatatcggtaagtatcagatcaaagggcgtatgatcaagaaccagaaatgcagatgcaggggattcaacccattccgcctcatacccttcctgggtaagatagtgtctgattatgtcagcctgagtcttactgtcttccacgacaagtatccggaacttgtgtgatgctgtcacaattgcctccgttcagatagtgatcgtaaaaacctggcaatttcgacaggaggaagagagaacatgccagcgttcagcatctctgccgcaccaggcatcccgtatacaaatgaactatcccggtcctggatgatagtacacccgccattttgcctgatctggagaagttcttctgctccgtctgaccccattccagaaagaagaatgcctaatacatgtgatccaagattttttgcagcagacctgaataaataagaaactgatggtcgcaaattatgctcaggtgggcttattgagaatgaaaacctaagatctgatgttactccggtatgtatcccgtcaggtgcgacatatagttttcctggttgtaacacctctccttcccttgcaatactgacaggaaaaccggttgattcagtcaaccacaatgccaggccttctataaagccgggggacatatgctggaccagaactaatggcagagggaatccaagagggagattacttataatctcctggatgacctgtggcccgccagtcgaagcaccaatcacaatgacccgaatatcctggtgaatctgaaatggaatctgaatagtactggcttctggctttggaactttcagatgattagatcgccttcgaataactttcacttcagaatacgtacgaatagcattcacaaattcagaaactgcctcttcatagtcaggatctccatatgcaggaggttttcggaagacagccagggctcctgcttcaactgctctgaatgaagcccgaatctcttcaagattgtcaataccgctgacgatgatgatagggacgggtgtccgctccattatctgtctggtagttgcgaacccatcaaggtccggcatattgatatccatagtgataatatcaggagcaagacgggaagcaagaatgatcgcctcctttccattctttgcttgacctataacagaaatatccggttccttctccaatatactctgaagtaccataagagttaccggtgaatcatccaccagcagtacccgaatcatctgcctgcccctataagtctagtaatcacttcgagaagattcccctggtcaaaactggattttatgatatacgcatttgcaccgacggtaataccatgttcccgatcttccctggagtcaagagaggtaaccagtattacaggaagatcagataatttcttttcagaacgtatcttttcggtaagagcaaacccattcattcgtggcatgtctacatctgataccacaatatcaaccgggagggtcttgagtctggtgaacgcatcaagtccatcaactgcagtttcaacatcatacccggccccttcaagaatatttttcagaagcatccgcgaagtgattgaatcctccactaccatgatctttcgccggcctgataatgaagatggcaattcttgttcagacactccgattcgggtcttcccctgcatctcttctgcaatatcttctacctgcaaaaccggcactatcagggcattactcagaatggcaacaccacttacaaacctgatatcctttaattgcggaccaagatccctgacaactatctcctgagctccgccaatctggtttactataagaccaaaacgcctgtttggagtcctgagaagtaccaaagaacgggcatcttcagactggggtgagccggatgataatccaagtactgagctcagcaaggcaactggaattgcctgattctccagatataaaaccgttcttccctctattgtggtgatatctgatgcatcgggaatcatcacccgttccacctcattaagtggtaaaaagaacgggcggttttcagcatatactaaaattcctctgaatgtcgcaagagtaattggaacggtcaggagaaaccgggttaatttaccaggaatactttctacatctacaataccccccacctggttaatcttctcctgtgcaatagcaagacctagacctctgccagatactgtggaaacatgtgatgatgtggtaaatcctgactggaatatcaaccgcactttctctctatcggtcagggcttgtgcttcatcctcatccagcaatcctttactgattgcaactgctactgcggtctgtggatcaatcccttttccgtcatcagaaatggtaatggagatctgattggcccggttatgaacaatttcaattgacaaatttccttctgcgggttttccatcccgtaatctgacttcttcaggttcaatcccatggtctacggcgtttctgatgagatgtatcatgggatctctgataccgtccaaaattcgtctgtctatttcaatatctgatccggttatcctaagagagactttcttcccctgttcacgggcgatatcacggaccattctcggatatgcatcagtcagcgatgaaaacggaaccagtacaacttccctgatactttcgataagctgggtgatggcagaatccatctcactgtgatcctgggtcatcgcccttatggttgaatcaagctttgtctcacaacttccgatgatgtcacgggtggtatcaataaagtgaagcagccggtctaaaaaatcatttgttccctggaactgtcgtttcagatttgcaatatccccttcaacccggctcaggctccacctccatgtctgcacactccgcgagattgattttaattcagagaggtgtgatcccgcagacatacgataagaaagcaggtcatcagcgctttcatacaaagaagtaagacgttcttcagagatccgaatcttcggtccagcaatcccttttcccgttgaagatactgagagtagttcaggagtaaccggttcactttgactcgtatctggtggagttgcaggtttccggataattggtttttgagggggatcttgtgaaacttcacgaataggaggagtttgcgaggaatgtacagctgttttcaacttttgaataattggggtgatttttacctttttatctccggcaagaagtaattcaagggttgtgatcacgtcatgaatcagatcaaactcaacctgtctaagaatcatctcacctttccggacagaagagaagaccgattcaagatgctggcatatcgtctcaatatccttcagaccgacagcacgggctgctcctttcagactatgagttgcacgatagacaggttctatctctgattgttgagacctggaagggtcttgctcgatcaccagtattccggcaataatcgcctgaagatgatctgctgcttcctcaccaaatgtagcaagcaatttcgcaagaaactcctcatcctgtagatccatgactcttttctcagactctgaaccgttcagtaatctctttcagactattcccaaggtcatggagatcgcgagcggtcttttccacctgcctgcttacttcaagattattttgtgcagccgttctgatattttccatggctatggagatctgatccattcccacaacctgctcctgacttgaagcagtaatctgaattccggcacgtgcagcatcagatatcccctgattcagaattaaaatcgcttcttgtgcctcctttgtcagtttcatacccgttgcaacggtcttggtaccctgctcagtagaaattaccgtcgaactgatgccccgttgaatatcagtcagaatgtttctgatatttgttgttgcctgctttgactgctcagcaagggttttgatctcctgtgcaacaacaccaaatccttttccaaattctcctgccttagctgcctcaatcgaggcattcaccgcaagcagatttgattgttctgcaatatcagtaacgctcgcaattatctcaccgattgcctgactctgttcagacaggcgaatgacatttgaagcgatagattccatctgctggttgatatgattcataccggtaatgatctcttcaaccgatgcctgtccgttcttcacaacctggttaaccgcttgtgacttttctgcaactgcctttgctttctgattggtaacctcacttgttttccgtacctcttccacagttgccgaagtttcattcactgcagacgcagtctctgcggtactggaagacagctgagcagtgactgataaaatctctgtggatgcagcagatagaacatttacaccccggtacaattcatcatttatgatcgtcatcattctggatagttcaataccaatcctgttcagggcttctttaaaggttacatattcacctttgacatggagtttctcatcaacacgggcagtaaaattccctgctgcatattcaccagatacacgcattgcctcatggaccggttcaatgacggcatcaagggttttgttcactccttccacaatccttctaaagtctccctgatggcgtgacgtatcagcccttatatcaagccgaccttccaccgctgcttctgaaagcatacggacatcgtttatcataagattgacagcttcaatacactgattcagattgttcttaataagagagaagtccccccttgcttcctcagtgatcttatcaggaatatctccatatgaaatccgttcaacatattcagcagcaatattcagcggtccgatgatcgcatccagcatctgattaattcccccaaacatatctctgctgtatccggaatatttggtgatatcaacgcggtaatcaagattacctgcaataccattagaaataagcaattcaatgtcacgattcctttcgttaagaatgttaacaagattgttcaggttgatttttatttcttcaaaagatcccgcaaacggctcagtaatgggcggggggatagttccatgggccatttcattaatatactcagcagtgatccccattggtctgacatatgcatcaagcgttgaattcattccggcgatgatcttctgaaagtctccttcatgtttatcagcgtcgacgcggtatgccagctcacccttaactgcagcttcagaaagcgagtgtgcatcctctaccatagtagcgatgtgagttcccatgtcattaaccgtcttacctaatactccgatctcatcattccgaaccagatccacacgtgcagtactatctccccgcccaatccttactgccacatccataagttcagttaagggactggtaatattcctggtaagaatatacgcaaccaacaaggaaataattccaaaaccggttccgacaacaagtataataagaatgagggtattcttttctgcttcagcagcctctatggttttttgtgcaccatgcaggagtgaatctttaagagcggagaacgtagcttcagttgcacgtctggcctctgcatgttctcccccattcatgatggaaatttttgcttcccgttctttcccacttttttccagttcaaatacctggagagcagcttttttatatcgatcccactgattcgtgaatgtgaggaaatactgatattgttcttcattcataccggcctttttcatctcttcgatgataggctctattttatctatttctgctaataatctctcatgatcctgttcccgttcttcagggagggctagggaacgaaatacaagagatcggatcgaatgaagcccgacctcgatatttcctacattcatcagaggtactgtctgttcagaatagagttgatcaacatcatcggtcagtttatttacactcataagacatgtcacaataatgagcgacataagaagaatgacgaggataaagcctccgaaaagttttttcccgatgttaatgttatttaagaatgaattgatgctcatgatttaccacataaattgttgagatttctgtaaccgacagcaataatgatttctcgagatgtccgaatttggtaatgggacaggtatacctttcatccatatttaacgctccttatctcgtgaacgatcaacgataagcttgggatgagtaagaattacccggctgtttatcaggatgagaggaccaggaaacacaccgatcagaaattcctttccaataccccggattgtgtcaggaggaggagtcagatgagaaaggttttgccatgaaacaccgtccacttgatctgcaaggactgcaaattccatcccctctcccgaaagaacgataattttattgtaatcagagagtccctttcttgggaggtcaaaaaaaactcgtaaatcagtaactgaaatgacacggcctctgatactgataatccctaaaataaaatcaggagtacctggaagagaagttaaatgacgaagttgggttacttctctcacatactccatggatacacaataccgttcaccattgagcataaaagaaagaacttcaactccttctcccatcttctcttctttttccagaggctttgccagtatacgggcacgctccagtaaaatttcagactcgtcgcggttatcctggtttaacatctgttccataatgaaaaatcatcccccgagaagcatctgaatcatatctttcatcttccgagcaggtattccctctgtctcttcaaggatcgtatcttcatcctttgaatccagaatatgaatcgccagttcataatgatgcctggcgagatcaggcctgcctgtttttttataaatccctgctatagcaagatgggcgggaagataatcaggaaatgcatataacgattgtcgaagtgactgaagagagtgattgtacagcccctgttcatcaagaactgctgcctttaacagatatggccggggatttaaaacatctgcagcaataagccggtcactccagccaagtgccttatcatattctccatttcctgcgtacgccctgattaatatctccatctgcctgatccagtgaggagaagactgaggtgcggattgggagatcatcttaccggcctcttcaagacggttctcggaaataagacgatcgaatccctcatcatcaggttcgagaagatagaccaccccagaagaatcaccaggtttattctcttcatccagaaatatgtcaccaggaaagtcgggtatatcatgaatatccggttcatgaaaaagatctccttcgatcacccttgttaccggtacggattcatcactatagaatgtggtagataaggatggagaaattttttcagcagcgactaggttgttctgatcaaccttttcatgaagaaaaactgagccatggtgatgcatcctgataaactgaccctggactatccctatttcctggggagaaacaatgaggaaacctccggtccgaagggaggttaccagatgactgacgacttcacctgattgttctggtgaaaaatacatgaggacatttctgcacagaatgagatccagggatgacggtcccagagcattataaaaggaagagtcatgaattaaattcatccgttcaaaacgaaccatggttctgacagaatcatcaattttcatccggttgtctggagtcggagaaaaatatgacccaatcggaataagtggatcatccctgaaagaccatcgggaataaaggccttcctgggcacgattgagcatatgctggttaatatcagtcgcaagtaagtaaatatcccagtcatctacgtctacaagcagataccggagcaggattgcaagggaatagggctcttccccgctactgcatgcagcactccagatccgaagatataatttgtgttcctgtcttcgtgaccggatgagatcaggaagcaatgaatcgcggaggaaaagaaagaggttcttatccctgaaaaagtaggtctctccaatggtaatgtaattaaccaggatttcaaggaaacgaacctgaaatgatgaatcattcacctgctgaacacaggtttcgaggggaattttcagatcagtgcaggcagaagcgatgtgtcgacacagatcatgggtatgccgatcatcaaacaaaatcccggtgttagctaggataaaatccctgattgtcccgatagctgcttcatccagaacatcgctcataaatcaagatattcccttatggcactgattttctcctgatcttcaatacccagcagatctttcggatgcgaaataatcaaaagaccatcatcacaccggtatatgccggtgatgcccttcatgccagcacagagctgttcaggagagatgacctcatcctcaatatgatataccccggagatggtttctgcaataatcgccatatgtcgctcctccttgacgatgattaaaaaatcctgaatggcaggtgacttctcatcaagtgagagatatcttctgaaggagaagaccggaaggacatcaccatgataattgataatcccgacaatgccacggggaggatcatccaccggtgttatggcaaccatacggatgacatgatccagaaggacagcaggaataccaaaccgtacattccggacagtaaaaacaaggatatctttagaatcttcacagactgaagattgagaaaaactgggattaccgactgttcctaccaccgtacatcacaaattttgcaataagggattgcatctggatatcacttccggctccttctgataaccggaaatccgtctctccgagtgaatcaataagccggaccttcaccgcctcggggagatcccgtttgaccaccgcacggtataactgactaatgagctcctgaggggcaatgccacggtcatgaagtaaggcctgaagagaactccccgctcccagaaaattaccggcaagactgaggtcaataaggtcatcaatctcttccggacgtgccgttgctgttattgcaaagatcatatccggactgatatccctgccaagaatcgctgcaccctgcaatgcattaatagctttcctcatatctccctgagcgacgtaaaatattgcatcaatgacttcttctgtcaccgtgaggttttgatcagcacttatccgtttcaccatttcagaaacagcctgtcgcccgagcggtctgaagcggtaaattgcacatctgctctgaatgggatcaataattttcgccgaatagttacaggagagaataaaccggcacgtttgtgcataggtctccattgtccggcgaagagcagactgtgcatcagttgtcagggcatcagcctcatcaaggaagagaattttaaatgttgatccgccaaaaggcgaagtccgggcaaactgcttgatctgatttctaacgacatcgataccccgttcatcagatgcgttcagttcgcggaaattcatctgccagtcttcaccaaaaaattcacgtgccagagcaactgcagcggttgtcttcccggttcctgcatttccggtaaagagcagatgcggcatctcacgcttcgctacatatgaacgaagcctttcaattatctcctgttgtccgatgatatcttccaaaacccgtggcctgtatttctctatccaaatggcgtgtgtctcttccatcttcctaatatcctccggacgtaaaccagattatttgtataggcatccctccattgatctggaatgatgcccattcttactctatatattactgatgttcatccgatataggttcttcagattgatctgaagaagacctgccgatgagaatatctgtgcatactttatacccatcctgtgctctgagatcttccggatctagggtaagtgtccgttcatagcagatacgtgctgctgcctcttcacccgccagaagcaggacatcccctaaatttctccagccatccggattttcagggtccagagtggtgacacaggtcagacttatccgggctttatcatactcttccgcatggatctctgacatcccctttagaagaaatgcatcagaccagtcaggattcaaagaggctgcctgtgcagcatttactgcagattcagcaaattgcccgagttcaaataatacccgtgcacgggaaagccagatctcagcactatcaggtatactggtaaccgcccgggtgaaaaattcgagcgcccggtctggatcccctgactgttcacaggcctgacctgcaaggtatgccagatgcccgtcagcaggtctttgatgtaagagcagttcaaactgctccgcagccttttcaaattccttaatctgggcaagtaatgaggcataccgaaacaaaatctgataatcttctggtttattttcaagtagagcagacaataaagttctggcctcttcaaactgttctgaatgcaccagcagatcggcaagtacgagtgagatctgagttccattatactgatccagccatttatacagaattgtaacagccttatcaacctctgaaagatgccagccccatacgcgggcaagggttgttatccagaaggaattatccggatcttctcctctctctttttcacagaatgacaccagatcatcccatcgttgtagatggtataaagatcgtgcatatccttcggcagcgtttggatcgccgggacgctgcatcagaactgaatcaaaaacatccaaagcatcctcgtaccggttacatgccccaaggacccggccatactggagcagaatatctggttcatccgacaataatactgctttctcaagggatgcaattgcttcttcatggcggtccagagtactgtatacaagaccgaggagcagatgagggaggtggctgtctgcatcaagccgggaagccatccggaaaaatgatactgccatggaaagatcatcccgtgaaagataaagcatccctttttttagccaggggatgacctgttcagggtcaatttctatgagccggttataacaccagagttcatcctcccatcgacccatctcctcatagagcctggcacaataaaacaaagtttctgtattatcaggatcatagtcgagggattcgcgaaaccatcgttcggcctcttcaggtttatcaagtttatgagatatcaaacccagataggtccggatttccgggttatcaggatcaaaaaccagtgcctcagtaaatgaatctgcagatttatgataataccccgagtcataccacatctttccaagttcaattctgggttccggtcggagaggttctaatgcaatgcacttggtaaagtattcttctgcttcactgagatctcctctcttgagtgcaattcgtccaatctcaaagcagacatcagctttctccgggaaccgggaatggagatttaaaaacaggtctctggcttcatcaaattttccagacagatggagagtgtaccctttattataccacgcaacagagtcctcgggatcttcatcgataatcatctgaatgcatgagagagccatatcaaattcttcacattttgcatgataagcggctctctgcattatcagttctttttcattcgtgtgcatacaggacctgacatgcaggatatgtcctgcagatgattgtacctatcagcaccagaataattgaactttcggaaaaaaaagaattagctggaggatgcaggggttccttccccaacctcttcagttacatttgtttctccatcagactgtgacggagtgacatttccgccttcaggattctcaataagctccttgaggtcaagggcatatttgaattcctgatcataggagagggccttatcgactgcggcccgtgcctcatccatcttgttcagtttgtagagagcaaatgccttctgtgcccacaggtcagctttggtatcatcaagtgctattgctgattcaaatgccttcagagcttcttcgaagttctcctgggtgattaatgccaatccctttgcaagatatgcacgtggacttggttcaatcgcgactgccttatcaaatgctgcgatcgcctcatcgagcttgtccagttttacaagagtggttccctggttatagtagtattctgcttcagagtcagagatctttatcgcttcattaaaggctttcagtgcttcctcatagttttcaagctcattcaggacaacaccataatcattccatgcgaccgcattggttgcattgagttcaacagcctttgcaaaggcttctgaggccccctgattatcttcattctgaacacgtgccagtccaagcgtatagtatgccttagagcgatcatcttcagtcatctgagatgcattgagtgcagttgcctgttcaagtgagtcagcagcatcctggtagttttcaagttgatattgagtcagacctttcaggtaatatggatcagcaagatcaggtctcagttcaatcatcttgtcaagtgctgttgttgcttcatcatacgagccttcgtcacttaacagaccaccaagatagtaccatgcatcagcaagattcggatttaactcagttgcagttctgaattctgcaatcgctcctgatctgtcgctctggtcaatgtatacctgtcccttccagtaatgtgcaacacccatctggggatctgcttctgatgctgcagtaaatgcttccattgctccggttagatctccctggtcatagagaacccgacccttgtaatagagcgcgtttgcattgtaggggttcagttcaactgccttgttaaaggcggtaagtgcttcatcaggattgttccggacttcaaagaggatacgtcccttccggtcccagacatcagaatcgcttccgacggtcaggaatggttcagagtaatctccctctatggtgagtacctggttaaaggttgcttctgcttcatcaaatttacccagtgcactttctgcaataccttttgcatacagggcatctttaaattcaggattcaattcgattgccttctcatatgcagtcagggcttcctctggctgaccaagatcagagagtgtaattcctttccagtaatatgcacgggaaccatcaggcataagttcaatagctttattgaatgattcaagtgcagattctgagtcggtattgagaagctgcgcaataccatagttcgtccagattcctggatcatcggttttaacctccacagccttcgtcagggcttcaagtgccgggaccgggtcgggtttttcctttccaacgaggtataggtatccgatattgccccatgcaactccgttttcaggatttaaattggttacattctgaaatgcgtaaattgcagattcaacatcaccggtcatcaggtaagatccaccaagtttggagtatgcctgttcattctgtggatcttcttcgactgcttttaaaaagttggagatagcttcttcgtagttttcattctcaagagcggtgagcccctgatcataccacccggatcccgttgcattctcttctgctacaactcctgcagtcagcactgacaggaaaagtaacgcaagaaccgggagtattgctccgatcttcatgccatatatatcacataggagggagagaaatagtttcttctttattatttttatagagaccaatcaacaatataccggcttatttattgtatgaaagatatatttttaaatgaactttcattgagaaaaatatacgtgatattggtctgaaattttatccttcatcgaaaagattgacaggatgattgttgattatcgcgaaaatccagaccttcgatttgggatattttttaatatacatcatgcgtatagtacggggcacgccgttgtggcttagcggtatagcggctgattcgtaatcagcaggtcgggggttcaagtccccccagcggctctaataccgaagtataatgccctaaacatatattgtctcgttctctcaaaagataaacccatatcttcacgatatcagaaagttactatcaaaccatatcaactataggctaaaaaaagataggcacttctagggtgctctatgacaaccttaagattgcacgataccacgaaggccggatgttcaccaatgggtgtttctcatttcctatcttattgaatgaacctataggcataccgatcttctgtgctgcttccttctgcatgtgaccatgggaaacaaatctctcgatacatttgatcatctctgcccgcatactcggagttatgggtataggctcatcatctcccggtatggttgtctccactgttggtataacctcttccactgttggtataacttcgggtatgacttcctcaactattggagcgctctcttctactgttggtataacttcgggtataacgtaggtatgactttccaatacttcttcacgccatgcctccaatgtggaaatgcgttccttaatctcttccaactcaccgggagatatggaaggtataactgcggtatgattcggtataacctcgccatagagagccttcctgattaattcacatatggttgtgctgaaaggtttgtctcctgtatactccttgacagcattatacagttcatctggcatactgattgcggtcttcatctcttcacctctggtataaccatagtatgactcggtcatacttaaggctttcataccgtcagttataccaagttatacccaaacaaaaaaagaattataattcgtgctctcccatttcaccaggtatgggtgcatctctagcaattcccagccgttctatccgggggatttctgaccggaagaataggtgtctgcttgcccactctctagtgtgctcatcagattgcaacgtaaccacctgtccccggctttacaagtatcgttcctacaacgcgggccgatcctttcctaaaaactgcacgctcaagaaccacagagaaggcggcctcattatatgcctcctcaaggtctgataaccgcctctggatggattcaaatctcattgaacagccccgaatgtttttgtaatttatcctgaagactggtatgactccactcttcaagcagttcaaggtttttgtgatagcgttcctcacgtgtttgtaaggttgcatcacttgaccacacagagggatatacatctgtcagcaaggttaccacttcctcatggctcctgcccttcctaccaggagacacagtctttcggatgttctcaagtgctatcaatcgtttaagtgtatttgggttcatactcgttcaaatctcccggtttttgcgttaaatgaaccaatcgtgagtttttcagccggacttgaattttgaattgcaacagcacttcggaccatcagagcactataacaggccatacatctcgataaacagatattcgtgcccgatgcttgacagaaattcttatccagtaatggaactttgaatccacaatattttttatattgagtcatgatttccttcctccaattttgataatctcgtttctatttcgtccaattgaagatccttcagtcctgcaagcgctgttgatgctgccataattgcagtccggagatactgaatccgaatcttatctgcttctggatctcgaatccggccttctcctgaagttttcttgcagcacagtctgatgatttcactcaaaacttttaggatttctgaccgtgacatactgtgacacggggggatcacatctgttttttggaagttatagacaactttttcagacatataaacgcctctttaagtttatgttattttaagcgcgcgatacatgcgcgttaaccgctgtttataaatacgcgcgcatctaatattaatgtagcgcgtggagaccgtgcctgtggtcccttcatccccacaggcgcgcccgcgcgcttacttctagaaggaatttctatgtctgaacttaatataaaatctcaagaaatatacggccaaatcgttaaagccgctgatgctgcgtgtaaaacgtttgttgacgcagccgaattagttagaaatgaaaccaaggctgaaacacgcattgaatgccatgaggccttcttaaaagcctgtgattcattccgggcaggctgggggcttccgggggggcagcccgatattgacggtataccaaaactcactgaaaggaaaagaacagcatacaaacgtctgttagactatacgagttgtatacagtggttttcagcaaatcgtaaagcaaaattcgatgaattcaaaaccatttgtgaaaagaacaatattaaagacccggaacagcaaaaggtcttatttgcggtttgtatcttcgatgtaagaacattaatcaaattagtcgatgaaaaccaagatttacgctgatatcttgatttgaggctcgttctaccatatttatctatctccaaaaaccaccatctttttttatctccctcgaaagtgagggagttagaatacccgacttttcggggattatggatcttcaaatcaaaaaaccagcagtgtggggagatataaccattttgtgtgtgtgtgttcgtttttcagggcacatagatcacaagtgccccaagtgccctgcttttttttcgataagtgccctaattttttatgaccatataaggttttttatttgcttttattgccaatattttttttattttatttctttaatattattatagggcacatagggcacttgtactaagttaaagttgtatgtaaaaaaatgttatatagggttaacttagggtatgtgccctatgtgccctgatccgggttactggatagaaattccctgcaaatatctaactccgtttgactttacgccatctttaaccccgtgtttttttagcagggcacttgtgaattttcggggcacttcagggcacatgtcgacaccaccacaccacacagcataatggttatacaggtcttttcttgaaattttaccgcttaaggtgcaacaatcttcaataaaacacgatatactgtcgttttccttccggactgattcacaagccgtttcgattgcagcagcccgggtgagccgaccaagcgcctgatagcgcttcaggccttccatgcaccagcagaagatacctgccgattcagccttgaatttgtcaagtatatccggatcgcggtcttttggttcgaaataatgattgaatggcaccagccaaagcctattctcaatggctttatcccaatcgttaaagcgtggtatggggttcatttgcaaaaatattacaaattcgggtgtatactcaaatatttcctgtcgaagaaaccttgccgatatggtatcattgccagaaaggcgttttataatcgattcatcaagaacggagccattaccggtttcagatgcgataaccagacgtgaacgatacagccgagccagatcagggctgggatttgatcctgaattggtgtaactcggagtgaggaacgtcttaaaatcagcagttttagcataatcgccgtgtaaatgcttcagaaggtcaagggttttgcctttgccatttctccccgaaccatgacaaataacgaagatttcatcaggattacctgaaaggaacgagtatccacataattcctgaaatgaaccaatcaaactctggtcattcaaaaatatggtctgtatgtgcttttcccaaacaggacaagaagcattaggctcatatgagaaattgccacattttgtgagcatatccgcctggagatggtccctgaattcatgactgtgaaggttatatgttccattttttaagttgaacaagtctggcttattatcaaacgattcaggaacatcagcgaccagtgcagcagcagaagttaaaagcgcctgtattttagatgcgctttcggatgcccgagcccaagaaaccaatttctttcgtaagtcgtcctcttcgatttttgaggcttcaacatacagcgatcgaacggtcttattggcaagtttgcggatctcttgcttccggtcttcccgccataaatgaccatcccagataaaccatttttgccatgctggtatgaatttggtggtttcaccatgcatatcgaagaagcgctcaccattccctaaatcggttaatgggcgccgctggttgggttcatatcgaagggcacttcgggctatgcgttggacatccgcctcatccaatgttggtatacaccgattattattcgcgtctgaaagcatccgaaacagttctgattcatctgtgatccccgtgcccactaaacggccggccaaagaaattaaggcgttgtttcgttcaccgtcttgatatacttcgtttttatagagttttgggattgaatccctttctttttggttttgtttgtgactgccatcgtcgtattttatgtcatcccgaaatggtctgattatacgcttaaaatctcccggatctggcagtctccgaggtgctgatgcgtttacaacacgataaacccctttgtcagttcggcttcctgcgccaaccacgaagccacgacaaccagccatatatatctcggcaagatgaagacctttttttcttttcccgtcgtgattttcttcaaattcatagaggattatctttttagtgcccaattcggcgcaataaaaataaatgtggtatcccccggaaggcgtccgaacagtgaggctatcgccgatgtaatcaatgacctctccgagcttttccggttcatcagcgtctaaaataacgagatcgccctgcggtataattccgtaattgttgccgtttttaaaccaatagtggataccacgataatcgagcggatgattgttttcgttttgccatttgtccccgataggtttctttatacccggtttaacaggaatgacacgaatattatcaccaagagccatgatttcaggagggatgcatgtttcctcttcagaatggttctgaacgcttaccgcttcagtcatggcgatcaaccttcctgatcagggcaagaactttcagcatgactggaagcgcttcattccattgtccgataggaaaataaacatcatttcttcctattttgtgatgcgagcaaagatcgccacaaattacaggaagcattaagggtttctttctgctagcgaaatgaagatttatggcatttgcaaaagccattgctgcttttcgctcttcctgcgatggaaagtcatattttcctcgcatcaagcgagcccaaatcgctgaagcattttgagcgaaacgcttattggctgaaacgtgtaatatatgattacagcgtgagtgtttgtttgtcttcttttgtggtgaaagaaggcacttttttttctcgatcatataagttcaattaacccccgccgttcggctatttctgcaattttctgatacagttcaggtagtgctcgaaggcattcacgagatatacgttttggctgttcaggctgattgttttccattggtggcctccatacccgtttttagaagttcttcgacatagcgtgatcggttaattaacccgcgcttgctgtcaatgcgttcaattatagcgccatcgagtgaaacagttactctttcgcgttttcgagtttctgaagtgtgatacttcatataatattgtttgacttgaaaatataaaaaaccgatacctataaatagtaatactatattagacagtgaaagtataaaaaagtattgtatgatctattcattctgaagttattttcttcttttgcagaagaattaactcccgaaggatgtcttcacctttttccccggtcaataagtcacttaagatcgatgtcgctgcttcagcggtctgaattgcatccttgttaagcggtgctccacatgatgaacaaaacgaatgagtaaacggattgacaacgccacatttgtgacattggataggttcaagccgcttcgactcaattgttggtcttccacgccgtttaatgcctaatgatcccgctgcttcattttcgatatcttcatcgcagagatgtaaataaactttgaacatatcagtctcgacgctgccccaacacatttttttgattattgattctttccaaccttcttttatcaaatgcgtgattctactatgtctgaacacgtggggggttatcgtatgttcaatgcctgcattggttgcagccttccgaatcatttttactagtccggcataggaatatggacttccatcactttttacaaatacaaaagcccccggtttatctgcatttcctgaatattcatttttccattgtgccagatatccacggctgttaaatagaggaattgtcctcgctttgccagtcttaaatgtggtgctgatagacacgtgctcttcatggaactttacctgattccattgtaagttacctatctcaccaattctcattccgccttcgtataacgtgctaataatagcctgattctttatgctgccagcgtgactaatcatactcatcacttgatcgggagtcaatagatctgatatgtctttagtcgccgaatcataaccaggcggatgtatctttcgaatcttcaaagcatcaagcccaggtgcagccatattattttcacataggtatagtgcgatccttcgcatccctcgaatgagatcagccattgtgttctgtttgaaaccatgatgctgaatctgatcaattgcatgataaatatccgatgtgaccatttgatcaaatggtggcaaccatcggcgaagtccggatatattgctaacaagtttcgaggctctggtatcgctgataccatttaccgcccggagttcagcaataaacgcccgtatgatcttctcatcagactctgtaatttcggacgcttcctttttgcgggttagtgtccggtcaatttgttcacgatattgatcatcagatctgtaaaaatgttgattcggattgtttggcatatagtatattaattaattccttgaggcattaaacttatgttaacaatccccccagcggcttaacattaagagttcaactttctggatctaaaaatctttttttttaaattaatcgccagatcgagcgatctcaacaacaatcatatggatacagaggtcttcattctgctcatagtccggacaggtgcatccatcttcaatgactatatactcttttgatctctcatgaacaaaataggcattcagatcttttcgaactattgccccttcgtttacgagccatatggcatgctttcctcttcctcaatatttctggattattcgattcttcatctttctatcataagggtatcatagatcaagattagcaagagggtcactcatatatgccctatcactaacccggttcttactccgtcacttccaaaacctgaaaaaccaggtttctatacaatatatcacaaacaaccgaacatttgcttcgggaaactcttgcttaagtccttctccaaacctgtgaatctggatggcatcttcttcccgaatagtgaactcttccaaggatattttcattcccgcccactcattatgagagatgattttaattcaatgacccatcgaagccggtcaaacttctcatgaaatttaccgacgaacaagatatttagaaaccatgatcgaaatcttcaaatacccttctattcaccacagtaatcgacacgtgtctcatgaataagcagcagtctattgtaagattatcagagatatgaaagaaacataccggttaacaagcctacagattgtcgcataagaagaaggatagaaatgagtttgccaatgtgtttcatgaatatcggtaaatattcataagatttttcctgatacctcttgattaacaggtaatagatttaatacacaaccacctcctcccggtcccatttcctcatccctaatcgtaccagcacaaaagctgggataaacagcccaactccagccagaccaaaccagggattcatcacagtcaatgaaccaaatatcgataacgcaatgccgataagcagaaaatactgaaccatcacccggccattatacaccagaacattgggagataatccagtcagccagatagataccgctaggacataatacgacaccgataaggtcaataccagaaccgggagcaggaattctccctgaccggaaagaaaagtaatcactgccataaagaagatcgggatcacctgaaggagtgtaaaggaggtaattttactggtaataacatctctgacatgaagcggaagaagagcgtagatactgaatgaatcaaacatacacagccaggtgtacatggttgacgcgataattccggtaatcatcgcaaaggtgagaagaagatgaatagtagaaacatactcatcaagcagggagagaaagaaccagatggtgataagcggtaccagaaatgaaaagatagtctgaccaacaatactcccggaccgccagagatctattacatcttttgcagcaaggggcggatttggaaatcggttgagatgacgaatgaggggtttcatccggttcgggtaattttttgtaccggattgaatatcaggtgaaaacaggagaagagcaatacaacagggaaccagaaccaacataacgcttccaagaagaagatgccaggaaaattggtaaaagagtataagcggtggaaaaagtgttgtcgggtttgttccggtgaacatgaaccatccaagaaatacaaaacctgctaaaatcagaaagagaaagagggcccttactgatcgcccgtacagtgatgacaggaaaaaaacaacagacataccggtgagaaatgagagagtcagcgttagaaggatattcaacggataaaaaaccggaattccggtgaagagtgatcccgcaagaaaaccggcacccaggggaaagatccagaggaaaaaataatacaaggtatccttaagcacaaaaatagtgaagatataccgggggctgagaggcagggtccgggcagagaatgcaagaaggctggcctgaccaaaccggcggttcattacttcattcccaagaaggccgaatgctccaaccatgaatcccagcatcagatattgtgcatgtatcaggatgacaagatcgccaatcggcattgtcgtttggatcaggggaaaaagaaatgtacccatgaacgcaatggcacatatcataactggaaagagggcaaaattaagactcccgaacatagtcgaatgaatccgccattcttcctttaacatattgtaaaaaagccctgccatggttatgtcctgacaagtgataggaacaaatctgacagatgacgattgccctctctgactgactccatggttccggtgtagagcagatttcccacatggagaattgcaacttcagaacagatctcttcagccgtttccagtagatgagtggagatgaagagcgtattcccctgcttcgtatatgaaacaaagaatgccttgaccttgtcctgcatgattggatcaaagttgataagcggttcatcaatgagggcaagttcagggttatgaataaatgcctgagtgagcatcagtttctgcctggttccacgggagagatccttgcagagcacatttcttttatcctcatactcaagaaaatcaaaccaccagtctgctttttgttccagatcagggatcttccttatatcaccgataaattccaggtattccatggcagtcaggaaacttggcggagattcctgttctggaatgattccaaccaaagttctgatacctaccggatcagttgccacatcaagaccaaaaacatgggcattcccggatgaagggactatctgaccggtcaacatctttatcatcgttgtctttccagatccgttcggacctaacagaccgaacagagatcccttcctgacgttcagggttactgcattgactgcgatcagatcaccaaattttttggtcagtgattcggttttaataatattttccatggtaccgcgactattattcattttcgtatagtgagagataggtttggttaattataaaaaaatactattagcctttcccagaattttggagaagattgtatttcatcgattatttttcgggacagatagtgagcaaatttatccggactgataaaaatcaatgtcactattcagaactcacatatttttttcaagtaactctttgtaccgggcaattcctctccggataacctcttcattaatttctcccctgccggatgggagctcaagaattctttttggtataggtatggattctggctctaatgaaaaaccctcacggactttaaaacggtatttttcagcaaggatcgatcttccaaggatatcaagttcttccaccgtaatgggtatcccacagacggacaagacttcctgaattatttcacgggtatacaggccacgggcaaagaaacacaccaccaggcctgataggatctgacgatacgcttcttcttcatacaattcttcagcaattttttccggtgtttcagggaatttttcttcaggcttctgatcaacactataccctgcattgtcaagatggctgtggcgagctccacagatatatccgatatatgccgcaggaccggtgtgatacccgggcatttcatttttcccaaaggcaagagcatactcttcgccaccatagactgaggctgcaaacgacactcctttccccaggatctggtaaaactcacccttttgtcgtgccagagactcgaaaaatgcaagataatgcttggcatcaccaaacgagagcctgatacctccggtcatttcttcatcaattagtccattattcatcgcttcagttgcccatgcggcgcagacaccggctgacatggcatcaactccgatctgttcaatgatgtcaatcagatacagaacatcagtgggatcagagacaccgagcatgaatccaagagcatagatcagttcatagtcataactcaccgggatggttttgtaaaagtacggatcattcggatagggaatccggatctgaccgatatgaatacaactgaccggacaatgggaacaggcaacacgacgggagagaaagagcctggcaaactcttctccagataactgatcagagccccccagtctctgttcagtgagatttttcaccggaagagatcccattgcagagagtgatttcacatttaccggtgttcctatctcatgatacttctgcataaggggagatctggttacctggtcgtaaagccggtcataaagttcccggtatctcttccggtcagataactcgatgagattatcccctgaaatcagaactgccttaagttttttagatccaaatactgccccaagccccattctgccaaaatgccggtaggtttctgaagtcacacttgcatatctgatcagattctctccggctcttccaatccgtaatatcgtcctggttcctggtgttccatcttttgaccggatgatacgtgctgcagtatcactccggccagtcccccacaatgcccgggcatcacgaaatgcaacaccatcttttgtaatagacagatacaccggatgtgaggctttcccggtgataactatggcgccatatccagccgacctgattgcaactgctgtccggccccctgcatgactctcaccaagatttccggtcagaggggatttaaacattgcaacacatttcgaagcgagagggaagagtgctgtagcaactccgacggaaaatataatcggattttccggacctaatggatcagccccttgtggacagaattcctccagcagcctgatagctgctccggcaccaccaagtcgttcctgaaacagatcggacctttcttctgtatggaatgaccacgaagaaagatcaataaacagaacccgtgataacagtgcttcaggactcatcagccatcaactcctgcagttcaataacttcgtacgggcagtactgtgcgcaatacccacaataaatacagataatgggacggttctcttcatgatcccaggatattgccccaaggatacacccttccaggcattttttacacccggtgcatttatctttattgagggtaactcctccacccggacggggcaggagagcttcttcaggacagagatgaacacaagggggatcctggcatgcccgacacaccctcaccgaaaaacctcgttcaatccccccgactgaacttacatgaatagcagatttggatactccgccaaatccaagccttcgggtacaggcaaacatacaggactgacacccgacgcacctgtcagcgtcgatgacagagagccgcttttttggcatatgatgaaatgggaatgaaagataatcaatattcgtaaaattagtaagaagagaataacagaaaaacaggttttagatatatctcggtttgagagataacatccggggagtgtataaaggtctgaatggttttccggaagtctctttcccgatcatctcaatcagcttctctgcagtgcaggtaatcttctgtggtttattgggttcagattcagaacggacagtaacagtaaggtttccggagttcatctctgaatctccaaccacgatcacatatgatacccagtccattcctgctgcacggatctttttatttaaggaatcatctcgatcatcaatatcggcccggatccgtgcctttgtaagtttttctgcaatgtcttttgcatatccaagatgattatcggtgaccggaattattcgaacttgggttggggtcagccaggtgggcagatgtgcaaccttctgattcacagtattttcaagaattgcacaaaatacacgctcaactgaaccggttggagaacagtgaagaattggtggataaacttctgttccatcagcaagatgatattttatcccaaaccgtttgctgctttcaacgtcaatctggacggtcgggttttcaatcggccgattctgcccgtcgattgcagcaaggtcaatctttgctatccagtaatgtacacggtctgaaagagtttcaatcagaattggaacaccggagtcttttacaatctttttgatccagccttcatactctgaatagaattcctcagtgcagcggaatactgcaaccagctgggtcccgaagtcacgcccggtcttccaccctatggcaagctgttcttcaaaacaggtcagggcattctcaagatccttgcacagagaatgcatatcaggcatggtaaaagcacgaagtcttttcagaccaataacctcacccttctgttcatgacggaatgaataggtcgaaagctcgtacatcttcatcggcagatggtttggtgagatatgcatactccgcatggtggtaaacataccaaaacaggctgcaaatcggagcatcatgttgcggttacctgatttgaaccggtactgccgctcaccaaacttgtctgcgtgttcaaagatggctttatcagcaagatcatacatgaccggagtctcaaccggacttgcaccatagtcaagaacaagggatagggcatagtctgctaagagatcacggaccagctttccacgggggagccagcggagatgaccgacatctgataccggttcataatccacaaactccttggaacgcatcagatcaacatggaccggttcgccacctaccggcacagcggtcccgatctccttttttataagagcggcaaacggagagtcatccatgtactcctgaacatcatgaatagtgccttcgggtgtaagaacaaagaatttatgttcaatatgtttcttctcaggttttaccgcatcttcagatggggtgattgaccgggagagttctgaaagcgggtgccctttacaggagagggagaacgatttataccatccaaaaggagctcgtttaacttcgtatcctgctttttccagggattcttcgatagccttcagggctgcaactgcaagatccggtgctgcaagatcagaggagaggtgtgcatacgggtataccattacccggttacattctaccttaccggccatctcacctattgcggtgaccgtctgacatatgacatcatcaatatcatcagcatccggtgactcaaccgcacaaaatgctaccagggcatcatcgaggcgatcggccggattacagggatcctctgcaaattttgttttcttcttcgcttcatattcaatgaaatcagaatgtattaaaagaaggcgcatgaatcagatctctccgtacaatatccatatatgttgatgtttatcgggtataaaacccgggtaggttccatcaatgtgaacaaacgtttcttaaaaaaagtattgaagatatgagcgtatcatgctcgttttttattctcgtagtatcgtgaaagcgtggcttgtcgctggtttaagtattttgcatcctttttagcattgtacggacaaagtgcccgctcagtcgtgtaaaagaccagttgaccaattggcattccggcatgcatcctgaccgggcgctgatttacattacacatctctagggtgatagagccggcaaatccggcatcaatccatcctccggtctgatgaagctcaataccaagtcgtgcaatgctgctctttccctcaatactggctactatgttatcaggcaggcggatggcttccatagtttctgccagaacaaactggccgggatggaggacaatactttcggcagtcatctcctcagtgccgccggtcacagtatcacggatatatggatcaataatctcatcacctggtgtataccagacaaaatgatttccaagcctgatatcaattgaatttggttgtattaactcaggattatacgggtcaatacctatatatccacgctcgatgcgatccgttatctgccagtcaacaaggatcatgtaccgatctgttgtttccgattactgtttatcattatgatcaggatcagtacgatccggatgtgaagagctttcctctccctgtggtggtgcaaaatgccactcagaacgcctgagaagaccatgaatggtactgcactcgcgccaggtcagattacaccgcccaagtacccgtcgaatcagggtcatagtcgattctcgtttgaaccctggatgatccaccaggtccaggtactgatcaatatgctcatagagatgattcatctcatctactgtcgccagaggtatgactccttttgggagatttgcgagttcataacagataactccgacagcatgggagaggttgatgataggatagagaggtgatgtcggaatggtgcagataatatctgcccgtctcacctcttcatttgaaagcccccagttttcacgcccgaagaggattgatatcgttccatctagatctctaataagatcccggatttccttaggagaataaaagggcattcgggtcggatgacaggcagaataagagagtgatccggttgtggcaatcacccggtgtgatgttctaaatacctcatctagtgtcatcacagttgcatgttcgagcacatcatccgcgtgtgaagcccggattttggcttcgtttccgatggtacagggattgatgaggatgagatcggtaaatccgaaatttttcatcaccctggcggcaaatcctacatttccctcatatagcggttcaacaaggacaatccgtatatggggcatttatcactgaactgcctggacggtctcaagaagggtcttaacacccttttcatagactgcatttccaacaactatcgtatcagcatattttgccatctctgcagccttttctgcggagtcgatgccaccgccatagtaaagaaccgcatgatcgatagcctcgccggcccgttttacaatgtcaggatttccgtacataccgctgtattcaatatatactatcggaaatttgaagtaatgatcagcgatggaagcatatgcggccacttcttcagcagaaatcccgcagtcagcccccgtaacacggcccactgctgagtttggatttaatacaatgtaagcttcgggaatgaccttttcccatacgatatcaggattcattgcccagtcacggtgtttgccaactatccaccgggcatcggaggtgttcataacgcttgcaacatacaacagatcgatgccgtgaaaaattactgattcaggtccggctggttcaacaacaagtgggagcccgtattccttcacctggtcacggagctgtgacatgttgtctttggtaatattgagcgtgcctgaaagaatgagggcatctgttccacttgttgcaatttctgcgatttcatcttcggtgagatgtttgtccgggtcaagcttggtaacgtgagcccaggtcttccattttgtatgcatatatgcctgtcctcaaaagtgctgtacagcttcattacttctgactgaaaaacattcgggagatccgggggatcataccactgctgcagcctgcagttttttcagatgatcttttgacaggccacctgattttgcaaccttagccggatctgcagaaataagggattttttatcaaagattccagctcgatacaggtgctcaagggtagactccccgaccccgggaagggaggtaagttcaattttccctgattcaaatgcttttttggatatctttaccggatccggctttcctaatgactgcgtaatcagggttgcgtgctttccaaccgtctcaatggagatgccggtcttgaatgcaaggtatgccggatgagcagaggcgatatcttctggtgttaaaaaaccggcttcctgataccgctttagtgatacggcaggaatgccgatatctttaagctggtttttcgcaatcagggagatggcttcactttttaatgtctttgcttcttcttcggagagtccggtcttttttagtgattcaatggtagccgatgcaatgtctccgatgcagtttatccccgactcggtaaaaccgttcatgacctttgtatgactccggccccgttttgggggtacaaactgcttcatgaactttttacattccgatcttctccggatgagatcaagaacgtcatttgcttcatgaattaacgtttcagcctgctttttggtgattcctagctttttcgccagaactgcaggctccagtttcgagagttcatacaatgaaaatatctttgcatcaagaagtttctgctgaagagcctcggtcattgcgggcatctttgcatagtgctctttctgctgctcgatgagctgacagagcggacatcccatctcccacggtcgggcaccttttgcgataagactgacgtggaagagattatgaacctcacagaccttctttgtcctgaccgctgatccccacatcgtccctggaagagatatgttacaagtacagtccggatacccgttacacccgataaattgagaaccacccttccgacgaatacgaagatcctttccgcacaccgggcatggtccgatggtcagctcttcatctgtctgacccataatctcctggccgatgactgcctcatttggttccaattcatcaaatacctgatgaagcatctttcgggaatcatcaaccaccccatcacgggacttatttctgaccttgatagcttccatcgcctgttcaagcttctgggtcatatcaggtctggtgatggttgaagcatgcgcttccagtgattcagttacagctttcccgacaagagttggccggagtggatttccttcgatatatttacgggagatgagcttttggatcacttcatgtctggtggattttgtcccaagacccagctcttccatcacctggataagtttactctgtgaataccgcggtggtggctgcgtctgcttctcttcaaggttcagatcctgtatcttcagtttttctccctttttgactacagggaggatggaatctttcgcctctgagtatgggtataccgtcctccatccggcctcggtcagacgggatccggttgcaacataattttgtccggttgcatccatcccgatccgcatggttgcccactcggcatctggtgacagggttgcaaggaatctgcgtactaccagttcatacaatttccagttctcaccaagctgctcttcggtcgcaacacctgtcggatggattggagggtgatcggttgaggatttctttccttcggtcggttttgtccgcctgtttttcctgacccaagcaacatcccgggcaaattttgtcttttctagcgtggtcagaatattgtcaaggttcagggatggaggatagatggtattgtctgtacgcggatatgagataaatccgttcatatagagttcttctgcaactcgcattgcatttgctgcagaataaccaatccgtgctgcggcaacgataaactgggttgtgtcaaatggagtcggcgcccggtctacccgttttccttccttgacttcggtaacaacaagcggatcctttgtcccggcatatgccgcatcggcgagtttcttatcagtaaaacggccttctgcatgacgtgcaataatagactgaccatctttctcagttgtcagggagatctcccagtagggttcgggaataaaagactcaatctctttctcgcgatcaactatcatcgcaagtgttggtgactggacacgtcccacggaaagtatgtttcctccaccccgttttgcagccagactgataaacctggtaagtgatgctccccagatgagatcaactacctgcctggcttcccctgccgctgcaagatcaaaatccagatcactgggttctgaaaaggcccggttgatctcttccttggtaatagctgaaaaccgtgcacgatcaatgggcactttcggattgactgcccggaccagctcatatgcctccttcccgataagttccccttcggtatcaaaatcagttgctatggtaacacggtttgcctttttggctattttatggatcaattttactattgcaggttctgtaggacgtttaatggtctctgcatcgattaatgaccggggaggtcgttcctgtgaccgccagttggtatacccttcaacgaaatcgacctcaaccacatggccacgaagtccgattgatatcttgtcgccaaaggtgtatacattcaccccaccctccttttttgccgaaactttatcctttccggaaaggatctgtgctatccggtttgctgcaatgtttttttcggcaataatcagatgcatgatatcagaccttcttatccagaatctctttgagaagcgtattcagatgtccgggatctgcacgtccccggcattttttcatgacctgcccgacgaggaaattgagcgcctgcatctttccagcataataatcatctatggctgcctgctgctcggcgattacttcctgtatcattgcagtgacctgatcaccactggtctttgcaagtccgagccggctcactatctcctgagggcgctctggttttttcccatctttgacagcatcaagaatcagccggagtatctccaccgcagacttgtcggtaatagtgtcggattttataagtgtgaggagttcgcggaagaggtctgaaggcattgcatcgatggaaaagtcacggtaattgagctcaccaagcaggtagtctgcggtccacgtggcagcaagggcaggatcttctgatgcaaccgtctcataaaactctgcaagtttgagaccgccggtcagggtttttgcatgctctggtgagactccgtactgtgaaataaaccgttcccttcgtgcatcgggaagctcaggaagttctatggcatcaacccaggatgcaacccggagggggagaagatctggttcagggaagtaccggtaatcattctcctcttcttttgaacgggatgacgtggtcaccccccgtgcctcaacaaaatgtctggtctcccgtgtaacgatctggccacgccggagcagatttcgctgcctggttacttcaaaggtgagtgccttttccacacctttataggaggagatattcttaacctcaacccgttctgatcccttcagtgatatgtttgcatcaacacgaagagaaccttctttttccgagtcaaatacattgagatattcaagagttgcccgcagtttgttcaaaaatttccgagcttcctttggagaccggagatcaggttcggtaactatctcaataagcgggatacccgcacggttgtaatcaacaagagtatattttccccgatcagtggtccccatgtggacagaacgtccgggatcttcctcaagatgtattctggtaatcctgacctctttctcaccattatcaccgtcaatcagaagttttccccattctgcaagaggtttgtcatactgggtgatctggtatgctttattcagatcaggataaaaatagttctttcttgagaactctgattcatcccttatggtacagttgagcgcctttccaaccttcagtgcaaactctatggcccgcttgtttaccatcggcatactacccggaagaccaagacagaccgggcaggtgtgagtgttcggttcgttgtcacgaaaatccgttgagcagctacagaacatcttagacttcgtgttcagctgacaatggatctcaaggccgatgattgtctccaggtcttccattatgctctcccctgttcataggcatatgcagtgtcaataatccgctcatcttcaaaatatcgtccgataagctgtaatccgaccggcatgctgtttatttttccacatggcacagacaaggcaggaactcctgccaggtttgccgggacggtcaggatatcagagaggtacatctgcaaagggtcactcttctccccaagtttaaaagcaatatctggcatagtagggccggcaattacatctacatccctgaatattcgttcaaagtcatccctgaccatctgtcgtgcagtctgggctttctggtagtacctgccatagtacccggctgcaagtgagaatgtccccagaatgatccgacggcgaacttcttttccaaacccggcttttctctgctcggagtaggcatcatgccagctcttcagcgtcccgacagcaggaccataccttacgccatcaaaccgggccagattactggatgcttcactggtacaggtgacatagtatgctgataaggcatatttcattgagggtatagtgcatggtactgccgttgcgcccattgactcaagtgtatcaattgcctgcctgactacttcagcaacgtttggatttacaccctcgccaaagaactcatcaggcactccaatcttcaggcccgtaatgtcagataccggattatgtttgtagggtttgtcaaccgaggtggcatcacgggaatcatggccggcaataaccgaataaaggtttgaaagcgtttgtacatcccgtgccatcggtccaatctgctcaagagagtttgcatacgcaataagaccaaaacgggagactctcccatatgtcggttttaatccgacaataccacaaaaagctgcaggacacctgattgaaccaccggtatctgaaccaatggcacaatcaacaaggccggctgcaactgctgcagcagatcctcctgatgaaccaccaggaacccgctggtgatcaagtggatttaatgtcgggccataggcactgttctcagtggtcgtgcccataccaaactcatccatattggtcttcccgacaatcgctgctccggcatttttaagcagcgtgaccacatgggcatcatagggagggatatatcctttcaatattttggaagcgcaggtggtttcaattccttttgttgatatattgtccttcaccgcaacggtgaccccggagagcggcccgtcaccataggtaacttcaggaatggtggtaataaacgcatgaacagaatcatccggatgaaatgtcagctttttcacgtcacatcacccgtggtgctttaaagtaccctttttctgtctggcctgcattctgcagggcttcctcctgagacaaggagggaagaacttcatcgtcacgaagaatattatatcgttcacggataagcggctgattctgatccagggtatcaagaacggcaaaatattcaagaatacctgaacactggttcgtaaattcatttatttcggaatcatcaatgccgacatcagcgagttttgctatttttctgacgtcttcagcggtaaccattgtacgtttacgtcctccttaaatgtgtaatgaaatctgaaacagaactgtgataaccattctgccgggcaatccgttttatctctttccagatcccggtcccgtactgcattgcctttttatcataatatgcgaatgattcaggcagatacagtctggcaacttcccgaagtggtttttttcggaccccacccgtaacccgatcacgagggggtattgcctgtgcagcgcatacaaccctgatatcaagatatggcattgacaggtaggcacccatggatcctgcaatactctgatcccggcatccctgacggggaagagaagcaaagtcacgggcaaagacctcttccaggagatgttccggagtctccaggtacctggaatatcctccaaagacctcatctgctccctgaccagtcagaattcgctcatacccaagactttgggctgtttctgcaacaaaaaacagagttgttccaatggccacatcaaccgggtttggatcatcaatgagggagataacaaccggtagagctgctgcgacatcctccggtgttatagtccttacgtgtaagggaagatccagaacttgtgcaactgcagtagcctgcctgatatcatggcatccttccatgcctaccactagacagggacgttttgcgattgctgctaccagagctgaatccacaccaccggatagagcagtaataccggaatctgatctcagttcaatggcagtcctgattgcatcagcaaggggaagacacgggcaggacggctttaccgaaccagtaacagaaccattgcagatgattgtcccggccggacatggaccctgaataatgccaaaatgatcccgtgcaacacatgaatcatattctagatagaattctccgccaaagtgtgtgacaatttgaggatcctcggataatttttgaataatttcttcatgagataacggtattccatccagctcgatccaaccggtcagatgcatatatctcaggaggtgagctacacgaattataaatgtgatctgaatacctcttccaccacctgatcacgttgagacagacttttaccatacaaatatatatacctccaataggtttgtggctatgaaggggggagtaattatgaatcgaggactcggactgataataatccttactttgttctgttcatttgcgtcagctctgcccccaggtttttgcctgggagaggaggggggccttgcgcttggggtatttgctccagaaaaaactccatccggagaagaacatatccttctggatgagattcaggcgttcagggaaaaaatcggaagacctatagcaattggagtgttttcagatgaatggatgaatgaccggaaatttcctgcagaaaatgcaaaaaccctgcgcaatgaaggaatggttccctatatcaggttcatgatgcgaagctctgatacaccatatcagaaagaaccgttctatactcttagcaacattgcattgggtaaatttgatggagaactcatatcctgggccagggaagccagatcttttggttcaccgatcctcattgaatatggtactgaaataaaccagtggaactatccctggaacggatactggaatggtaaccagaagggtcaggatttattcaaagatgcataccgccatattattcgtattatgcgagaagagggtgcctcaaatcttatctggatttatcatgtaaatgcagagagtcagccagcagatgaatggaataatatgaccgggtattatccaggagatgaatattgtgacctagtggcagtatcgctgtttggaaccaaaaaaccctttgagaccggaacaaaaaaattcagcgatgccatttatagtactttgtccaccctgcaggcagggggaatccaaaaacccatcctgcttatcaccgggacagatgtgcagagcagatttgaggatcctgctacgtttgtatcaaatgttctctcatcactttccggacagacctggcctgatatcaagggtcttatctggctcaatgctgcctggaagaatgataataatccacttcatgatacatcaatgagactgcaggataatgcaacggtggcagctgcattcaaatcgggtctgcagaccatacagatccaggggcttctgacctgttcataattttttaataaatcccatgcacaaatgcggactatctcctctgctttcttctgattgcagagttctgatccttggaagttacccctcagtcttatccataaaagccggggaatattatgctcatccccggaacatgttctggaagatcatggaaataattctcaatatcccgcataatcagacatatactacccgtatctcacttctattaaatcatggaataggattatgggacgtgtatgcagcatgttcaagagagaaaagtgcagatgcccatatcaaggacccggttccaaacgaattgaaaactctcatcctgaatcatcaggatatcaggatcatttttttaaatggccgggcagctgaaaaaggcttcagaaaattttttccggatatatctttacaaactatctatctgccatcatccagccctgctcatgcagtacatctagaggaaaaaatcaaacggtggagagaaataaccaagtttctataggtgcctgatctcccttttctttcctgcgtaagttgcacgggagccgagttcttcatgaattctcataagctggttatatttttctacccgttctcccctgcagggtgccccggttttaatctggccggtgccgagacttaccgtaagatccgcaataaaggaatccacagtctcaccactccgatgtgatatcattgaactccacccggcatttcgcgccatagtaacggcagatattgtctcagtgactgtccctatctggttcagtttgatgaggactgcatttgctgccttttctgaaatacctcgtgaaatgcgtttcgtattcgtcacaaaaatatcatctccgaccagctggaccttctttccgatggcttttgtcatcgcaatccacccattccagtcatcttcagagagcccgtcttcaatggagatgatcggatatactgcgaccatatcctcataatatcctgtcatttcttcggatgagagtttcttcccttcactcttcaattcatatacaccatctgaataaaactcactcgatgcaggatcaagtgcaagtgagatatctttcccgggtttatatccggccatctcaattgcttcggttataaaatccagaggagcccggtttgatgagactttgggagcaaaacccccctcatccccgacaccagttgagagacctcgttttttcaggattgcttttaaagtgtgatagacctcacatccccatctgacagcttcaggaaaatcaggagctccgaccggagctatcatatactcctggaaatccgctccctgccagtttgcatgggcacctccatttaaaatattcatatacggaaccgggagaagatatgtccggtctgcaaggtgttcatataatggaacctgtaatgcctgggaagctgcacgagctactgccatggaaaccgggaggatcgcatttgctccaagatggcctttgttatccgttccatccaatgaaatcaactggttgtctacagcaggctgatcagtactgtccattcccaacagggatttgcgaatatcggtattgatagcctctaccgcttttttaacacctttaccaaaaaaacgaaaatcaccatcacgcttttctattgcttcatgtgttccggtcgatgctccggaggggcatgctgcccgtccaaaatacccgccgaccagagttatatctacttcaacagcgggattaccacgtgaatcaatgatctctcttccaaaaaccttctctatctgaaccataggatttccttttatgctccaatgcttgcaaggctgcaggattctgtcacatatacccagtatgaacgggtgggctccaacatccttgaatcagcctgctcatttgatccaccattgacgatggttacctcaaactgctggatagcagggtcccacccgataacctcagtccaggtattcctgatagaaagcaatgaatcacgggctgatgccggagtatttccagtaaatccaaacatgttccatccggcagtcatatcctttaccggggggacctggagggggtcatctgaaaaacgaaggtgaacgcgaaatggagtggtggagtaaacccagtatccctcaagcgggagaattttatcatcagccgtcagatcattccatcctccatccttctgattataggtccagatactgtgaccggcagagtcaagaccgttaaaaatagaggctgtatttgcatcatttgccagacgtcgggggacagatacaaaattccaacccgcaaccaggtttatagacccatttagatagtcggatacttcctgatcacctggccctgatagaacaggtgtctgttcacctgtaacagattcttcccctgatactaaaaaactgcatacaaataaaaaaatgcagagtacaccgaatagtgataatctggtcataacgtccttacctgcttttccaattaaaagcatttctgtgtaactatatttcactttgtcgtcatgagatattctctttacatcaggcagacatatgctcttttgtgaaatccttttcactcacagagtcacaacttcctttcgatctcgatctctcactctcatgcgggcagatatttggatggaagaaaacaagggatacatggaaaggggtacataatgggagtattgtaacaatcagacagaagggcattctcatcgaatatgatggattatcacagcaggatgtcatccggtttttagggttatctgatcccatctctgatattatcgaatccataagagaacatatcatcgcatacaaaggttcaccagatcgattttttgaaaccaggtacagccagtcacggggactccggatactcaggcaacatccctgggaatgcctggtgagtttcatctgttcggcaaactcgaatgtcagcactatcgggaaacgaatcaacctcattcttgggcgatatggcacctcatgcacactattcgagaacacgttcccggatccagcagtactctctcaatgccaggaaccagaacttcgggaatgcctgacaggataccgggctccctacctgataaaaaccgctcagtatattcatgagcatcctgacttctttcatcaggtcagaaaaatggaataccatcaggcaaaagacacgttgatgaatttacccggagtcggaccaaaagttgcagactgcgttttactctttgcatttgaacatctcaatgcagtcccggtggacatccggatacggaagataattgaagataaatacgccagtcttatccacaccgataagagtggaaaactcccctatgatactattggcggattctgcagggagtactttggtccttatgccggatatgcccaacaatatctctttgctacccgcgatttggaaaaaggagaggttaccagatctgctgaattaccatgaatacacaataagcacacgttgcggtcagcggaatcgtaatgatccatgccgtgacaatctgcctcacaatagaccactgaactgctgaacttccctgcgttgcaccaacccccatgatacatccactgattgcatgagtgctggataccggaacaccaaaaagtgttacaaataaaagaacaaaaccgccgcctgcttcagcacaaaagccctgatacggacgcaggtgagtaatccgcttcgccattgtcctgacgatcttccatcctccggtcagggttcccagtgatattgccgcactagacatgaggattacccagagagggacatggaagtcattcaatacccctgctgtaaccagcatagcagtaattatacccattgcatgctgtgcatcattactcccatgaccgatactgtaaaacgaagccgatacgatctgcagtttattaaatattttattcattacctgctggtctgcattccggcataacctgataaccagacatccgaagatgaacgctcctgcaaatcccagtgatggtgagatgacaatgaagagaatgattcctaataggccgctgataggaagaatatggaacataatacaaaggggaattgagaacacaaatccaaaaaatcctcctatcttcagataatgattaagatcgggctcatgttttcgcttggcaatccctgccagaaagactgcaccgataagtgccccgataagcccgaaaagaatcacccctccgatcaacggcaatgaaggaaggatgacaacactcatccccccataggcaaccgcagttccaatcagacccccaaccatcgcatgggtggatgatatcggaatcccgatatatgcagtcgcataaatccagaaagatgcgacgagaataccaacgataataacctcaagcgtaagccattcaggtgccacaatccctttcccaatcgtctttgcaatagccgtggtaaagaacaacgggccaataaggttaaaaaatgctgccagacaaactgcctgcaggggtgtcaggacacgggttgcaacaatggtagaaatggaatttgccgcatcatgaagaccatttaaaaaattaaaaaggagagcgatagcaatgccaatgatgaggatgctttccatactgatcacgaatgcctgatactgatatccgaaaggacgttcgcaacatcttcacatttgtcagtagcagtctccagacactcgtaaatatcctttaattttatcgtcgtcatgggatcttccaaggcaaacagccgctggattgcatgagataacagatcatctgccatgttctcaagcctgttaatttctatgccacaactttccagtggattactgttcctgaaagaacgaattcccttcaccccgcattgcagctggactgttgacaacctgataagctgggcaaagttctgcatcgtcttgtcatagtcctttattccataaatgaaaagtttctcagccgaatcatcaatgtagtccaaaacatcatcaagtgctgatgcgagtcttgatatctccagcggatcaagcggagtgataaatgtgcgatttaaatgttcgtatatttcatgggtgattaaatcgcccctgtgttccagttctttaatctctttataggttgattcaggctcagtcttttttgtaaccatctgctccagtttgtcggccgcctgaactacaataccggccatttgctcaaaaaggtcaaaaaatactttgtcctgtggaatcagccattccttaatccccacagtaatctgaacaaataccccttacatacgtaaaaagacaccggtctgtcaccataccatatcaaggatgataagacctgcctgcagaaaaaatgaatacccaatataacatgccgcagatgtcgtaaccgcaagcgggaacgtaactatccatgtcgttacaatatctctcacaacattccagtcaacagcattttttcccctggtagcaccgaccccgacgatagagccactgatgatatgagtggaggaggtaggaataccggatattgtcagggcagatatgacaagccctcctgcagtagatgcacaaaatccctggtatggccgaatccgggttatcccttttgccatcctggtaatgacattccaccctccgaagaccgtcccggcgccgatggcaagggctgatgctgccatcacccagaatggagccgagaaatcttcagccagacctccggcaataaaaagggcggcgataatacccactgcatgcaggccatcgttggccccatgtcctatcgcctgaattccaccggcgacgacctgaagggggaagaaaattttatttcttgtactttgccgggaaaatctgaagatataagagaccaggatatcgagaaaaaaccctccaagaaaaccgatagtcggggatatcacgataaaaataaaaatcgccagaaggccgcttacttcgagagcaccaacgcccataagagaaacaatcataagggaaaaccccccgacagctcctgctacaactcccagctttactggtcctttgagtatccagaagatgatagaaagacaaactcctccgcagagtgctcccacaaaaccagacatggcaacagactggagcatcagaagagacggccatattaccgtggaaaggccaaatgctgcgattgatgatccaaccatacatccgataagggcatgacttgctgatatcggaaatcctttcgccgttaaaatactaaggagcaggaccccgcaaaaaagtgcaattaccaaagttacaggagtcagggcacccgcttgtacaacaccggttccaatggtctttgcaatagcagtcgtcaataaaaatggtcctgcaatattgcagactgccgccagaatgagggcatatagtggtctcactgcccgtgtggctactatcgtggcaatcgaattcccggcatcattcagaccattgacaaaattaaataatagtgccaggaaaatcccaaagatgatgataaattccatggcttacgtatgacgaatgataatctcattgaggacatgtcccacatcattacattcctgcaaaacctcttcgagattttcatagatatccttgagttttataagaagtatcggatcctgcatagagaatagttcagttacagcagaagagaggagatcactggaccggttatatacatgattgatattctgacaggagttttttatctcatgaatctcattccaggacccgagcagtccaacaccttcccgaatttctgcgactgatatagatataaattcggcaaaggtattcaaatgggggtaggtcccgatcaactgataattgcatatctgatgtgcaacccagtcgatgatatcaatgacatcatcaagagcttttgcaagacggtgaatttcatctggttcaagaggagtgataagtgactcctccaatcttgcaaaaatttttcttaacagttcgtcagattcatgctcaagctgatgtatcttctggcaggtaatgcccctgtgttgattcatatcagatatcagttcggtcagatgcgatgaggcttgaactatcttttcagatatttcacgaaaaatttccagaaaatattgatcttccgggagaataatattccgtatccgcatatcttctggtgatacctgatatattatatgagtatgtgttccggctccaaattacacaaaaggacctgaaatttcaggtcatattgctcattattgcaaaaaattcgtctgccggaacggttgcaagtgctggaaaggttctgttctgcaccgaataccgctgcattacctgatattcaagccatgcaccatacaatgaaaggcgggcagtaatcccggagatctgtgcagggtactgaggatctgatctgtttaatccaggaatccggttcagactggtcagttctgactggactgtccggttatatgcctgcctcaaataagacaaatcctgtgacacattatacgagtacgtttcattcaaattcttcttcaggcgaatatttgcatattctacagagagattcagcacatcagggatgtcataggtgacagagccatcaacccgtcctttgatctcatataaatcaggaatccagtactggttcatcataaacagaaattcggtgtcattactggtatgattccccgatataccgacatcctcccctatacagggataaatacacatgagaaaaattgacagatatatgatggacatatatgtcagacaaaaacgcataattatctcctataaacctctattgatcattgagtttatctctggagacatttgaaggtatcagccctgaaaatcatttaataaaatccagattattgtaaccggatacaagaaaccattaaaaaagggtatgcacaaaaaataggggcaggttagtgagtgaattctgaagtccgtgtactccatgttgatgacgagcccgtcatatgtgatttaaccaagttgagccttgaaaaaggtggacgactcaaagtcgatgtggcctcttcagctgaagaagcattggatcttatcaggtcgggttcatattcttgcatcatttcagactatgaaatgccaataatgaacgggctcgattttttaaaagaggttcgaaatattgaccaggacattccgttcatccttttttcaggaagagggcgtgagacagtcatcattgatgctataaataccggagcagatttttacatccaaaaaggcggcgaaccaaaagcactgtttgccgaactcaagcataaagtggagtatgccattcaacagcgtaatacgcgcatagcacttaaaagaagagatggtattttggaagccgtcagcctggtcgcgaatctgtttcttggtggtgaagcatttgatcgggccctgcaggaggcaattaccctttttggtctggcaaccgaagtggataccgtcagactgttcagactgaattcagattcagaagacacagatacacatcactccataaaaaatatagcttcatggacaaggattacgattcagacagatgaacgggagcaatacataaaaaccaataatatcccggtggaaaagggacttttatcccgtcttgtaaggggtgagaccctcatcctcaatgcatcagagatccagatgtatgatcctcttaagggtggaataagtgcaaaatccatcgccgtatttccggtttttgttgatcagaaagtctggggtatcttttggtttgctgattacatgagtgagcggacatggactggtgtggagattgatgctctgctcgccgcatcagccatgataggttctgctatccagcaggatcagatgcgacgatcgcttattgcagccaaggaagaatatgcatccatgtatgccctgatgagacggctttgtgatacggtcccggacattttatgggcaaaagatattgatggatcattcctctttgtaaaccaggcaggttctcatctgctctgtgcagaaaataccagtgatccggtaggcaaaagagaggaggattatccctgtggacttattcatcatggaatgtcagagtgcaaaaatgtgagccatcataatataaatgggagaatatctctcaaaaccggatcagaggtcactgaactggatattatcacggtcccatttgtcaataccgaaggaaaccagataggaactgttacgttaggcagggatattaccaattattgtaaaattgagcagggtcttcgaatatcggagaagagatatgaaaatatcatccgtgccatccacatcggaatacttgtggtttcaggagatggagttatcaaagatattaatccccgtgccttggaattactggatgcacgaaaaagtgagataattggaacatccctcagtaaaaaccggattctccgtgagatggaagtatcagatgcagttcgtgaagtgatatcgactggaaatggcatttctttcctgacatcacgctcggttaccagaacctctgaagatctgtactgtatggtaggactgctggtcccggaaaacggaggggaagctgaggttcttatcactctcgatccccattactcagaataatcagagaagtgaaacaaggtcgcgaagaactgctgcaggatcttctgccttaaccacactggatgccagcaggactccatccgttcccaggtcaactgctgtctttacacattttcctgagtggattccggcaccggtaagaacttttactgcaggactgatttttctgacaacatctacagagtcagtaataatatccggatttgcttcagatacagatatttttccaccaataagttctggtggttcaattgccacataattcggattcagggcagcaagagcagcagtggttgccacattattcgagcagacacatgagagaagcccggcacctttcagggcactgacattcttttcaatgtctgcaacattcagccggtattctgagtgatttaccagtgatccgattgctcctgcagatttgatcgcagccagaggcattcggccggtatgggcaccaggatcaaccgggtctacatgctgggcaaaaaccggaatatcataatgatgatttatgggatgaatatctgtatataatggtgccagtgcaatggtaaccccagattcatccattatttcacgggcggccctggcaatccgatgagctccgtttccgattgattcggtataacacttcagattaacgaggacgagtggtgttttcaatgactgttgtttcatatggcattcattcgtcgttggaatacttatcagttaacaattgttcacgtatgatacacgataaaggagtcttattggttatggtttaacactacaaagaccccttctgtaccctgatcgggttattcctccccagctcatactgataatggtatctctcaactgatgcacctcttcttctgaaatatcaggcatcatccgtctcctccataaccgtgtcatttcacctgaataggtaacaccccggccgcgggcgtcaataataaaccacctaattcccatctgatacagtaccggatattcactaatcaggctgtgctcagatgaattcatgatatgacttcttcctgattgttcgcaccataccgggaatgaatactccttttcatcctgaagaacgagcccggttcctttttgtttgtgagcatatgcacatatatgatcttctgtaaccgcggcttcaatgagaccctgacaacatagagctatggaagggccggtttttttcctgtatacctgacagatatcagagatctcttgttctgacaattcaggagacagggtgcagaactcataccggtcacatgatgttatcgatgcggtatttgtcaccggcagaccatagtaagaggaaaccgaacaatcggggttacattccaggatatattcaccaataccaactgaatcgacgagaaaatgacggataccaaaagaagcaaattttttcagatgagtaaggaagagagccagatctttctggcgaatcactccggggactacaatgccgatcttacgagcatgatctgataatccacacattttatcagggaaatcctgccaatccagatatacccggtcagcaccatgattcaaagcagtatttgcatcaggtatggatgagacaagaactatcaggttagatctctctattgccggtttctgattaccattattatcagaagatacatggtcaccaatcacgttccggatattataaacgatttctggttttggaaggtgggattgaataattatgtcttcagcggcctctaggatctcacgccggagtctatttagtacacgaacaggagcaaaccatccttcttcaccggagatcttaatatcatcgaaggtaaaaaccgtccctccggtcttcataagttgtttccggatttgatccggtgtcagagatcgtgtctttgcaggttcaacgatatcaggacctatgaattcaaactgatatgcatgttcacgtctgtcatatacaactccatttccaaaaatgatcccttcaggagagaacagaagagaacatgatatcgtgagcgacccagcataccgttcatccggctgggcaagaagggctgaaatttttcgctccagttcccttcttcccgttatatagcaacagacaccggccttcgggacaaagggagccttcaattctatgaagccatctcgaaaaaccggatcatccctgaggacaaggccctccataaaatgctcatttctgaagacaagtccatcaccctgccggagagtaatatccgatactggttttaccctgatttttcggttatctgatgagatgacagaacccagataatatccctggttaccaggataatcacggcccataacctgtgaataatctgacccattgatatatccggatgtaaatccacgggaaaaggcaatcgagagatctgcaatatcttcaggatctggatggaatgattcggtcctgattgcatcgagagcctttcgatagattgaggtgacagttgcaacataggcaggagatctcattctgccttcaattttgagagcagcaattggcaatttgacaattttatcaagaaacggatagagtgagagatctttcgttgaaagcaggtatccggattttccaatctcacgggcagcattaaccctgccatactggtcaagtggtccttccatcatccggtattgtttccggcagggctgagcacacatcccccggttcccgcttctccctccgacaagtgaggataacaggcaccggcctgagtatgcataacagagagccccatgtgcaaactcttccagatcaaccgtatattcgctcaaagcctctgaaatttcttctatctcttctccggtcaattcgcgtgccagcacgactcttctgcacccgttttttgcagcataccgggcaccaggaatattatggacacccatctgcgtggatgcatgcagaatgagatcagggatgaactgtcgtgcataggaaagaagtccgatatcctgaataaggacagcatctaccccgatagaaaacaggaacagaaggtacgaaagtgctctttccatctcctgttccgttatcagagtatttacggtcacatatacctcaataccgcgaaggtgagcatatctaaccgcatctttcagttcatcatcagagaagtttgacgcgaactgacgtgccccaaactcacgaccaccaagatagaccgcatcagcaccggcagcacaggcagcgatgagagcttcaggtgatccggccggtgcaagaagaaggggaaggtgaatagtcatagatgataatcatggctcctgtctgcaatctgggatgatctttctctgctccagaagggcatccatgagaaccagtgccatcatcgcttcagccaccggcacaatcctaaccgcaatacagggatcatgccttcctttaactgaaatcttccgttccatgccattcgtatccaccgtctgctgaagagtcctgatagacggggtcggtttgatactgagtcgtacgaggatatcctgtcctgatgagatcccccctaaaatacctccagcattatttgaaagatatccctcggaagttatctgatcattgtgttccgaaccagtcattgatgcagccattacacctgatccgatctccactgctttaacgccgccgatacccatcatcgcataggcgatgagagcatcgagttttccaaataccgggtcaccaagaccaggcggacatcctgataccacaagactgaccacgccaccaacagactctccctgatccctcgcgtcacggataacctgttccattctttcaggaacttcttcaccatgaacagaagtcagggaaccggagataatgatgccttctttctcaagataccgtctggctatagcacccgctgctacccgtgcagcagtctccctgcctgagctccgccctccgccacgatgatcccgtattccatacttttcaaaatacccccgatctgcatgacctggacgaaatatctcttgtaattcatcataatctgcagatttcattgaagtgttctgaataagaaggcagatgggagtgccaagagtatatccttgaaacactccggagaggatctgcactgcatctgcttcttttcgtggagttacgaaatcactctgtcctggttttcttttatcaagataatactgaatttcgttttcagaaattgcaaagccgggaggacatccatcaataaccacaccaattgctgctccatgactctcaccaaatgtggtaacccgaaaattccgaccaaaggtattcatgccagtatttcccgaagtcgcgagatcggagtttcaatcccggtaagaatccggaactgttcagcgagctgatgaataaacatctcggttccagggattacagagcaacctgaagccagggcggcctgaagaaggggagtatcgcggggagtatagaccagatcaaataccttcatcccaggttccagggcggatggagggatcggggtatgcgggtctgatcccattccgataggcgttgcattgataagaagatccggatgatattttccaatatcagcaagggttccaatctctgcaccactctttcttgcaagatgctcagcacgttcaggtgtccggtttaggatcaccggtgtaaatccccgcatagaaacagcatatactgccgcagctgctgccccacccgctccgagaattactgctgtgtctccatgagtcccttcaagaggccggtagatacctttccagtcggtattaaatccatactttttatcatcctgaatgagaatggtgtttaccgcaccaatggattcagcatcatgcttgatctcatccaggtagggaatgactgtctctttgtgagggatggtcaccgatagtccccgaactccggtccctggcaaaagtgagaggaaacgaccgggatccttgtgttcaaaccaggtgtaatgagctggcatcccataatctgcaaataaatgattgtatatccccgggcttttactatgcatacatggatatcccaaaattccatagaggaaaatatcataatccccggatatctttttaagatgaatcttttctcctgatgggattgcagtcttcatgacagaggcaaagagctctttccgtttatccggaacacaaattccattttcaatcagattcagaatttgttttgctgcctcctctggtgtggtgatggtggtatctatcacaatgtcagctacactccggtatatcggcattcgttctttcaggacctgttctatctcttccctgggagaaagtccggtaagggaaggacggtcagatttatgaatcctattaaaaatcacttcaggacttgtattcagaaggattacaagactattcattctcagcatccggacattgacaggccgaataactgctccacccccggtactgattatccctgcatcagatggtattcgtgcaatgacatgttgctcaatctcacgaaatccggcttctccttctgattcgaatatctgagaaatcttctttcccgtcacatcctcaatgagttgatctgtatcgaggtatccctgaccggtcattcgggaaagcgcctttccaatactgcttttaccggtcccccgataaccgatcagcacaatacggcgttttgccatatccgtcgtaattcctcccaaaaacctggataagattttgtcacacattcagcatcaaggattgtaacatccccgataaaacatccaagtactgcaaaactcattgcagtccggtgatcattctccggatggatgattcctccatgcaacggagcaggatggatgacaataacatcctcttctgtctcaactcttcccccgagagtagtcagtccattcgcaatcgccgcaatcctatcactctccttcatcctgagatggtggaccccggttatccgggttggtgaggaggataccgcggcaaccatgcagacggtctgtacgatatccggacaatcagccatatcaacctttattcctttgaggagaacatctggatcacgggaaaggatgatcgactcccgtttttcggttatggaacatcccatattgacaaggatctcaagtagtctccgatctccctgggcagattgtggattcagtcctgatatggtagcagatcccccgcagatcgctgcaagggcaaaccagtacgatgatgatgagaagtctccttcaataccataggtctgtggtttgtacctcctctgcgaagagatcgtgaaaaccggttctttgtcatctccatcgactaaaacttcagcgccaaaagcacgcatgctgtcaatagtcatcataatataggggagcgaaaccggatcgccggtcaggtgaatatgaacatcattgtctgcatagggagctgcaatcagaagagatgaaataaactgacttgagatactcccgtccacatacatatctccagcaggaaatgtcccatctatcctcaccggcggacatcccggattcttaagacaggtaatttttgcaccggcattattcagggtatcaataagagggcctaagggtcgttcctgcattcgcccactgccggtcagaacgacagggccatcagcaagaagagagactccggttaagagccgcatcgaggttcctgaatcctgaatgttaatctcctcaacaggggcctttagatgccctcccgtaccctgaacgcggatattctctctggaccagtcaagccgtactccaagctgcataagagcacgcgcagtcattcgtgtgtcatcggcatccagttgtccgatgatctcagactgaccatctgcaagtgccgcaatgataagtgcccgatgagtataacttttcgaaggaggtgctgaacagctgaaacagaccggtccgcatcgtcctatgttcatctgcatggattctctccggtcagatgataacaacccagatgttttaccctggtgattttcctgatacgatcaattgcctctttccattcaccttcgcattgcaggtcaataaagaagacataatttcccatacatctctttgaaggccgtgattcaatcctggtcaaatttactccggtctccttgaatggactgagaagatcatataaaagaccggcgcggttttctcctggatcaactattatactgcatttttctggatgttcattgctgtagggctctctccgaatcacaatgaaccgggtgatattatcgggattattctcaatattactggcaagtaccgggatacctgaactatcagccagagtctgtgaaagaatggcaccagatcctggtcgttctttctgggcaagggcacttgcagcattactctcggtatgaatgaccggaatgcccagatcatcaataaatttgctgcattgctcatgactttgcggatgagcgaagataactgaaattttatcgagagttgtatgtgatgccagagtatgatgaatcggcatgtaccgttcttcagagatgtaaaccggatgctgcatgaggccgtccatggttgctgtaactccaccggcttcactgttctcaagaggaacaagacccgggatgccggtctgaagtacctgagtaaaaacccggccgattgtcgggacgagaatgatctccgtatctatcatacatgcaagatcatgcgaaaaagtccctgctggaccaagagttatgagagtcacctgctcaccatcgcctgaataaggaggtcagtctccttttgtgcctggtcgcagaatgatccgtaccattcgcgggatgcaagaaattctccggtaaatgcattccgatctccttcttgaattatacataacatctcatcaaacgcctgcttacaggtatccagaactgaaggaacctgaggattcatacagaggatatcagcgtaaaggtctggattttgagcaagtaatcttcctgcgattccggtttcgatccggtacaccggactcatatatgattcagtatctgccggggatatcccaagcctcctcatggtcccggctagcaatattgccttaaaatgagtcagcccctgaatcactgccatcatcctgtcatgctcttcagctgtcgttatcgtaacccgggcaccctggctttcaaaaatcttctgaaaaaaactcaaatcattctcatgacatcgggcgggggtagcaactatcgtctgtccctggatggtcccgacagtcgggccaaacatcggatgaagtccgataaccctggctttcgaacacatcatagcattgaccggatcaatctttaatgaagtcagatctgccaggatctgatgttcaccaaggaggggggctatctcataaatgacagagaccgtgtctctgatcggaacagaaattactatgacatcagccaggcgggcaatatcctctttctttaggggagtattccgtccggctatgagtacttcgtgaccggcgttgcgaaaaacctgtgaaaacagatttcccatgcccccggtcccgccaatgatgccaatcttcatgttatttctcaatgatggtctcatcaattgccataccaaaatgacgaccgccactttctacacggcccaggacaacatcaccgggtttgagtgaggttacagatactgccgaattatccgggcgaacaagcctgatggtctctgcattctgcaggataattgataccttctgacactcgctctctgcttcaacaagaaagagcggacgccgttcaattttcaccctgccaacagtcgcttcccggcaggatccgtttccatgaactatcatcacccggtcacctgccttcaggtcagccagatatgcagtctttccttccggaacctgcagatatgcatgaacgccacctgcattcaccctgaacggcctgggcgctacatagggatttacaagcgtctctgcatgaacgagaaaaaatccggatgatgtatttccaacaagcatcccttcgccgtcaaccataagagaacaggtatcgacacagaccctctcacccattccggcaggttttacagtggttacggtcagacggtggagttgttgtccggatattcctgactgaaccatccgacatatggatctgacaaggtccggatcatccgttttcacgaggacacccgagactcctttttcaagtacagtcagagcctgctcagcctcttttatatctgaaacgacggctattacattgtccccgcatgccaccaggttttcaagaggaattatcgtccagtcaggagtgtgcacgataatgcggcaggtcctggcagcttccattgcacgagcctggtcctctgtattcccaatagtaatctcatgaatatcctgccccggaattagatccccatcaggagcgatgaccagaatacggcccagttctctgaccggacctgctgaatctgcaattactcctgcagctcctgattcaagggcggctattgcaagttccttatcccacggacgaaggtctacaaatacctgtttcatattccctcaaatagcctcaggacggactccctgatgtacgacctgcgatatattggacacaaattttgcaacattgtcacgctggaaagcatttcttcccatgcagaccccggcacattttgcaaagtggacagcatcgtagatggtcttgtaacagtccaggtcctctcctttctctccacctgcaatcagtaccgggatggacgatgccttcacaatctttgcaaatgattccggatcaccggtgtagttcgtttttaccagatcagcacccagttcttcagccacacgaaccgcatgaccgacatgtcgtggatcatttggatcaatacccttcccacgcgggtagatcattgcgaggagaggaatcccccaacggttacagtcacggacaaccatgccggcagattcaatcatctttgattcctgtggtgcaccaagatttatgtgaatggataccgcatctgctccaagtgataccgcttcttcaacactgcagatgaggactttgtcattcgggtcaggattcatgcttgtaccggcagaaagatgaataataagccctatatcccgtccttttctccgatgacccggacgtacaaggcctttatgcaggatgatggcatttgctccaccgtcagatacttcggcaacagtctcggtcatatttaaaagaccgtcaatctgtcccagagtcatcccatgatccatggggattattaccgcttttccggtatttctatccattatccgttcgatacggatctgttttccaatcataacatgcctcctttcagcatctcatgcacttcagctgcactcataccgtcatgaacaatttttgcacaagcacggacaaatgatgccggatttgcatgctggaacgcatttcttccgatagagagtccggctgccccgccttccatcgaaccttcgataagttcaagagtggtaagatcatccgtctttgatcctcctgccactacaaccggaaccggacagcccctggtaacttcacggaaagtatcaggatcaccggtgtaattggtcttcacaaggtcagctcctagttctgcagccaccctggccgcaagccgtacatgctccacggcatgttcgtcatcaatcttccggccacgcgggtacatcatggcaaggagcggaactccccattccatacattcaatggcaacatgcccgagatcggtcagcatatgtgcttcagaatcggcaccgatattcacatgcatcgaaactgcatctgcacccatcttcagggcatttgttaccgaattgaccagcactttttcattcggatccggcccgatagcagtcgatgccgagagatgcagaataaggccgacatcatggccccgttgccggtgaccatgcagggccagacccacatgacctaggactgcatttgcccccccctctgcaacagaatttactgcatcaggaagatccacaaggccctcaatgggtccaagggttactccatgatccatgggaacaataattgtctttctggtgttgcgattcatgattctttcaagtctgatatctttccctctcataacagatcactcctttttgatacgagtaatcactcagtaccaaaaaaactgataaaagctaaaaaagaacgaataaaaacgatactcgtcagaacggtcgttcggtacaaaagacaagctggaagaagcagaactgcagaacgcaacagacttcacaccctccacacagtttgtcatgatcaggggtcagtgttgttacttataaacctatcgctatcgtgccatgccatagcatagcatggatgatgtacaatgcctacattatcatttcacgcacaaaaaatgaggaaaattacttcttcgccttcttgatctggatgacatcccccatcgtggtagtcatcctggcgtggtgcagatcagtcggttctgatgaaccttcgtccagcagactgatattgagtatcttttccaacttctttcgaacctcatcttccggtatcagttcgcctttttcaagtttctttacgaggagctcacgctccatcatggcaagggcaagatctttctgggtcattcccagtttcatccgtgcatcccgaatccggtcagcataatcttcaacaagatcgcctcccatccggtcaaacagatccctggatcgttggacctgtggtcttgtggaaccggaataggcggatgttcgtactgcctgtgctgcagatgtccggggaactgctccctggacttcagtgccatattttgcacagccattacacaccgagagctcggccccttcgatcttgatccttttcaaagggcctttggcttctgcgccgcacatttcacactgcattttcgcaaacatcatatagtcacttacccctatatacctgattgatcagatggcagaagcagcccgccacccggatgacatgaaaactcctgacgagttataccggtatttagtagaccgggttgcaggaatggaatcgcaaaaccaggaattgaaagagcagatacggcaactggagtcagataagcgatatattgagacccagaagatccggtacgaacgggaggtcaggaagctgaaaagcgagattgaacacctgaaaacccccccgctcattgtcggaaccataactgatatcatcgattccggccgcgttgttgtgcgttctagtgcggggccccggtttctcgtcagggtgtcacaggcagttaatccgaccaccctgaaagccggtgtcagatgtaccttaaatcagcaatccctggctatagtggaagtgctcccaagcacatatgattcacaggtatatggtatggaactggttgacgctccgactgagacctatgaggacataggcggccttgaaaagcagattatggagattcgtgaagcggtcgaacttccgatgacaagacctgatctgtttgagaagataggtattaacccacccaaaggagtcctgctttatggccctcctggtacgggtaaaacccttcttgcaaaggccgttgcacatgagacccatgcaatcttcctgcacactgtcggttcagaactggtccagaaatatattggtgaaggagcccgtcttgtcagggaactatttgaccttgcgaaagagaaggcaccatcaatcgtattcatcgatgagattgatgccatcggtgcatcacgcacagaagccatgacctctggagaccgtgaagtgcagcgtacacttatgcaactcctcgcagccatggatggttttgagccacgtggtgatgtgaaaattatcggtgcaacaaaccggattgatattcttgatgcagctctcctgcgtccgggacgttttgacaggattattgaaattcctctccctgataccgaaggcagatactccattctgaaagtccatacccggtgtatgaacctgtcagaggatgttgatcttatggaggtagcccggcttactgaagggagaaacggagcagaactgaatgcaatctgtatggaagccggcatgtttgctatcaggaaggaacacccgcaagttgatcaggaagatttcctgactgctctaaataaattcagatgtgactttgagagggatcacaggttgacgaccgcaggcgttatgtttgcctgattactcttcttctccctcttctgttttttgaagattgtccggtctgacagcttcaggtgcacaaagccggcagacggtgcactcttcttcagaacagagtacttcgaaaacatcctcgtcacacgcctgatctctatcacgagtgcataattctggaaaggtatcatattttaccaggttaccatctcctttgacccggtaccagatcttccagggccagggatctgcgtgaggttctctttcaagataccgtgatctggcaacggacggggtacaatacataccaggagctatctcaaaaagataatcagacccaaatttcctgataaagtacttcaaatctgaagccagggagagcgctgcagatagtgaactgaccttaacaattatgccgaccggagtttctacaggaccataaaaccgaagcgcattccatgcggtctcggatctcctgagttcctgatataaccttatccccggtctgctgaaaatcagcagattcataaaaaacgatattagcggaacatccgctcttcagaatcatgctcttcgccggtaaccttgtttatggcatcaagcagatcctggttcgttacttcaaatgcactcttccgaacggcaaacatacctgcttccctgcagactgcctgaatctgtgcaccggtgagcccctcggtcagaacagatatttcagcaagatttacatcaggggaaagattcatctttcgggtatggatctttaatatctcctcacgggcgatgatatcaggtaccggtatctcaatgatccgatcaaaacgaccaggacgaagaagtgccgcatcaagcatatcaacccggttggttgctgccataatcctgacatccccccggttatcaaacccatccatctctgccagcagttgcatcagggtacgctgcacctcagcactcccgcttgtcccgtcattggtccgtgttgttccgattgcatcaatctcatcgataaacacaatagacggggcccggtcacgtgccagtgaaaagagttcgcggaccatctgggcaccttcaccaatgtatttatgaaccagctcactgccactcatccggataaaagtggcttttgcattatgagcgactgcttttgcaagaagggtttttccagtccccggaggcccatggagaagaattcctttggggggttcgacaccaatccgctcaaaaacttcaggcattgtcagcggatattcaaccgcttccctgatctcttctatctcaccactaagacctccgacatactcaaaggtcacctcgggggattcatcaagctccattaccctgacccttgagtcataggtctcttcaagcaccttcaccactgaaagagcattgtttacagcgactttacatcccggatagatgtgggggcgcagttcatcagcgagtacagttacatactcctggttgttccccatctgacgaagataaacctcgccattttcaaaaacatccactaccagcgcaacaaagaggggcattcgtttgagttgtgaattctctcttttcagtacagaattttccttgattaattcctctgatctgatagacaactcaagattctgggcctccagctcctggatccggatctgatagtgaatctcattttcacaggagatacgtgcaagaggctgttccatagtacataattatccagtcgttctacttatacgtgagtgtgcatgataatacagggacgcggaatatcgcgtggtattggaaaagggcccttgctcattggtcctgatccaatctcatttctctccggcgtagatccggagactggaattgtattagaacccggtcacccgcttgaaggaaaagacatcacggggtcggttctggcctttgaatatgggaaaggatcaacagtcgggagttatattctctatgccctctcgcgcaatggacatgctccagcggcgatcatcaaccaggaagcagagaccatcatcgttgtcggcgccataatgggaaagatacccatgatcgaccggattaaaactccccttaccagccttccatccggcacaatcgtagaggtagacgggacagcaggaactctgaccatccctgatgaaaaagtgaatcaggtctgaaaatcaggaactaaaagaatattccctgacatattttttatcaaggtatggaaatccccattccgaacaatagccatcaagtgtttttatatcggtaatcactttcttcccataattatctgcaagatcctggtatcgacggtaatttccaagagatgccgcatcagtccctgcattcttccagtacacagcctgtttcagacttgatgcataggatccaagagatctgataaaacccaggtatttgttaaaaataacttcctcttttgatgtgagaccagggaagacatttttttcaggaagtgaccggtcaagggaatactcatctgtcaggtcattaatagccgtctcaagagccagcgccttttcctgaataccagctgcatcaagagcacgatcagcagtcctgattgccatataagctttcgttagttctggaaaggtgtcctcaataaaaactcttagctgcccggaaccgggtgtatcaggagtcatcacccgtttctgaacaggctctgcagaagaagggatctgtgtcattgttaccaccggctctccggcggtcgataccggaacaggaccactatcagagagcgaacctaagtcctgatttatacaacctgatgacagaatacctatggtcaatataaatacaagaatgaggaggacctgattcttcatatcatcggataggaggactgaatatatatagtgaactggtgaccagaaggtaccatcgtgctctcccttttaatcctgataatatacgtgctataattatcaatcttctgccatgtaaagataacagaatagatggtattcatatccttttcgtctcataccttcttttgtggaactcttcacaatcatcctgaccataataggtctgtgcatgttcgagataatctgtagtattgataacgctatcatcaatgcagaagtgctcggctccatgcaaccaaaataccggagatggtttctgctatggggaatcctattcgccgtatttctggtccgcggactgcttcctctcctccttgtctggttttcaacacctgaactgactttatgggaggctttcactgccatgttcagtgacaatcctgatataaaagaggccatagaaacctcttcccctattctgctcattggtgggggaacatttcttatctttctcttttttcactggctcttccttgaagagaaacacttcgggcttcctggagaacggtacttcttttccaagggggtctggttctatgcagtagtatccatcctgctcatggcaattgtctggtttgcaattgaaaaaaatgccatgatggcgtttggagcagttgtcggatccacggccttttttattgttcatggtttccgccagaatgcagaactgcaggagcagaaacttatcaacggggatatgtctgacataagtaaaatcctgtacctggaagtcattgatgcgacattctctattgatggagttcttggggcatttgcttttactatgtcagtcccgctcattctgattggaaacgcccttggtgccattgctgtcagacagataaccgtcggcaatattgacaggataaaaaaataccggtttttgaagaacggagcaatgtattcaatcctttgtctggggattatcatgctcattgacagtttcggatttcacatccctgaatttgtctcgccggtgattacattcacagttgtagggttattttacatgaaatcagtgcgcgaagcagggagtaagactgaatcagcctgattgatccatgcatatttttgcagctgaatcaccatgttttagttgtacaaacaccaatagtattggacacattttcgcatcacatattttttgggaggtttttgtctgtccaatacatacaattctgagaatatcaaaattctacggggccttgaaccggtcagggaacggccggccatgtatatcgggtctaccgatagccgtggtcttcaccatcttgtttatgaggtggttgacaattccattgacgaagcccttgcaggatactgtacccatatccaggttgtcatccaccaggatgggagcgtcagtgtggaggacaacgggcgtggtatcccaattgacccgatgaaggacaatgataacaaaactgctcttgaaacagttctcacggtccttcatgcaggtggaaagtttgataaaaatacctaccaggtgtcagggggtctgcacggggtaggtgtctcagttgtcaatgcactctctgttgaactgactgctacggtctggaaagacgggtatgagtaccggatgttcttttcacgaggtcagccacagacagaccttgagaaaaaagaagaagactttgaagagatcaaggatcggtatataaagcggtacgggagccttcccgacaactgcccggaaacaaaagaagaatttctgaatagatatctttccaagatctccggaacaatgatcaggttcaaaccggattcgaagatctttgaaacgattgagtttgactatgatattcttgctcaccgattgcgtgaactcgcatttctgaattccgggatcaccatcagcattgctgacgagcggtgtgaggatttggaggaatgcagcgaagtcttctcttatgagggcgggatatcagaatatgtcagatatctcaatcacgaagctcagccaatccatgaatcggtcatctcttttagccgaaaagatgaagaagccagggttgaggttgacatcgcattccagtatgcagccgcatattcagaaaaagtatacacctacgtaaacagtgtcaataccaaggaaggcgggacacaccttgagggtttccgatctgcccttaccaaggccatcaataaaatgggaaaggaaaacaaggcgatcaaggaccagaacctctccctcaagggtgatgatgtcagagagggtcttactgccattatatcagtcaggatggcaaatccccagtttgaaggccagaccaagatgaaactggggaacagtgaagtcaaaggaattgttgattcactggtctatgcatcactttgtgaatacttcgaagagcatccaaaagaactcgccgctattgttgacaaggctgtattggcatatcaggccagggaagcagcacgtaaagcaaaagaacttgccagaagaaagagcacacttgaatcatcaggacttccaggaaaacttgccgactgctcagaacgctctgcagaaaagagtgagatatacatcgtggaaggagactctgcaggtggcagtgccaaacaggggcgggacagacggttccaggcgattcttccccttcgtggtaagatcctgaacgttgaaaaggcaacggtccataagatattgaaaaataatgaaattcaggcactcatttcagcaatcgggaccggcgtgggcgagtcattcgatatcgaaaaagcacggtatcaccacatcatcatcatgaccgatgcggatgtggacggtgcccatatcagcactcttctcatgacattcttcttcagatatctgcagccactcattgaagcaggatatatctacctggcccagcctcctctctaccggattgcgaagggaaaacaggagaagtacgcctacaccgaagaggagatgaaagagattttacaggagatgggtgaaaaaggcgtgaacgttcagcggtacaaaggtcttggagagatgaatgcatcccagctctgggcaacaaccatggacccggagacaagagtgctcaaacgggtagtcatcgaggatgcagcatacgcaaatgagatctttgaaaagctgatgggtgatgatgtaaccgcccgtcgggattttatcaaacggcatgcaaaagaggtgacgaaccttgacatctgaagaatcccagcagccactctttgtcccgaaggtcaatcctgtcaatatcgaagaggagatgaaatcctcctatatcgattatgcaatgtctgtcatcatcgggcgtgcaattcctgatgtcagggatggattaaaaccagtgcaccggcggtcactctttgccatgtgggagatgggaaacacccatgacaagccatataaaaaatccgcccgtgtagtcggagatgtcatgggtaagtatcacccgcatggtgatgcatccatctatgataccatcgtcaagatggcccagcccttctcgtaccggatgatgctggtcgacggtcaggggaacttcggttctgttgacggtgacgcccctgcagcaatgcgttatactgaggtcagactgaaacgggaagcagaagaacttctcaccgatcttgaaaaagagaccgtcgagtttgtcccgaactttgatgaatccctgcaggaaccatctgtccttccggcaaaactgcccaaccttctcattaacggatctgacggtattgctgttggtatcgcaaccaaaatgccaccccacaacctgggagaagtatgtgatgccgtctgtcactacctggaacacccggatacgacggtctatgaactcatgcagattatgcccggtcctgatttcccgaccggaggtatcatcatggggaccgacgggattcagaatgcatacctctccggacaggggaaactgaccgtcaggggggttgcagagatagatgaatcaggaaaacgcaaccagatcatcatcaccgagatcccgtaccaggttaataaagccaaacttatcgagcatatcgcagagttagtcaaagagaagaggattgaagggatttcggatctcagggatgaatctgacaaggacggcatgaggattgtcatcgatcttcggaaagatgcacgacctcagctgatcctgaatcacctctataagcacactgctcttgaaagcacctttgggattattaactacgcaatcgttgatcgtcagccaaagatccttggacttatccctctgattgagcagtttgtccgtcatcgaataacggttattacgagaaggagcgagtttgacaagcgaaaagctgaagaacgggttcatatcctccggggtctgctccatgcaatcgacaatatcgacgcagtaatcacgactatccgagcagcacagactgcagatgaggcaaaggaagcacttattgccaaattctcccttgatgaagcacaggccggtgcaatccttcagatgcagcttcgccggcttgcagctcttgaaaagcagaaacttatcgatgaacgggaacaactggaagctgaaatcagaaagcttatcgaacttctctcatccgaggataatatcagggctgaaatttcccgggaacttcaggaacttcgggaaaaatacgccgacaagagaagaacccagatcaccggtgatctacaggagattgtcagggaagatcttatccctaacaagcaggttcttgtctgtctgactcaccagaattatgtcaagcacatggatgtggatgcctaccgggttcagggcaggggaggcagaggtgttatgggaatctccattaaagatggagattatgtagaacaggtctttgttgcaaatacccatgaccatctcctctgtttcacctcaactggacgggcatactggctcagagtctttgatataccggaaggctccaggcagagtaaagggaaggcaattgtaaatcttcttgaccttcggagtgaggaacgggtaaccgcagtcatcccggtccaggagttctcatctgatcggttcttcctcttcctgaccgaacgaggtatgatcattaagatcccacaggatgagttttcacgcccgagatctaccggagtaaacgctatttccctgcgtgagggtgataacctggtacatgtcatggtcagtgatggtagccaggagatcatcatcacgacaaaatatggtcagagtcttcggttccatgaggaacaaatacctcttcgacaccgcaatgctcttggtgtaatcggaatgcgaatgaaagatgatgatatcgtaaccagtatgaccgtcatcgaagaagggaagcatctcctcaccatcacctcttcagggtatggaaaacggacgaactttgatgagtaccgtggtcatggccgtgggacgatgggtgtcagaaacatcaaactcaaacgaaatgatggtattgtcacggcattctccgcagggcctgaagaagagatcatcctcatgagtgctgaaggaattgtcatcagaaccagcgttgaaaagatcacgatacagggtcgttcaacccagggtgtcaggataatgagacttgcggcaggtgaccgggtggttggtgtcacctcactctctccggaagagcaaaaagatatcagtgatgatataccccaggcagaaataatcgacgagggaccggatgaaaacggttcttctgacgaataattttttgtgtaagccttttattacttaaaaaacagacattgaagaaatgtcactttctatttactcgggttattccctcatgaatcatccgttatatccgggtttcatcagagaagtaaaagaagataatgacattcttgcagtgtatcactatggaagttcagtaaacagaagtgatttcagagacattgatatatgtatcatttcatataatgatgagcaatctgctttctttgatagattactccattattcaggatcttatgcagcaatgggtacggttcccctggatattacgttattctctcttctccctctttatataaaaatacaagttatcagggaaggaataccagtctttattcgtgatgatgatattctttttgataaaatcttaaaaacgaacagacaatgggacgattatgaaccatcttacaggataatgatagagtgaccaataaagaaagaatccgcaattcaatccgtttgcttgaccagtatatcgatgaattaaacaaaatatttccggaaaattacgatgaatataaaaaatcactcatcatcagaagatcatctgagcgacaaatacagatcataattgaacaaataaatgacatttgtgctatgctctatcgatatgtatgttcaggtatagcgggagatgaattgtccatattggaaaaattatcagaacattgtctttccacagaactgtgtgaaaaaatcagacatatgaaaggttttcgaaatatcctagtacatggatatacatcactcaatgatgccctcgtttacaacaatatctttcatgggagggcatatatttatcaatttatggaagaggtggaagattgtttgaaaaaattacactaaccggtacaggtttcgtggtattgatatctcaaacctgacaccttttccttctttcccggtttcagtaatagaaagtccggtaattgagaggatctcacgagacaggaataacccgaaaccggtgttttttccaaacccatgatggaatatcttctttttatccttttcaggaatcccgacaccattatcttcatatattaaaagaagggccgaaggagtctcctcggtaaagaacctgatctgagagacagtctctccatgcatcagggaatttgagataagatttgagaagaccttttccaaaagcgggtcggcatatatctcgatagagttgagattatcatcccagctcacacactccacccgtccatactcacgggcattggcaatggtagatcccagattctgccactgaggctctttgacaccaacatcctggtattccttggtaaacacaatctggcttctaattgactgggtcgcttctacctgttttgcgataaatggctcgaggtcaggatccttattcttctttttcagaagatcaaggtatgccagtaaaatagtaatttggttcagaacatcatgacgggtaatagatgagagcaggttgagctttcggttactctgaacaagggcatcctgagctatcttctgcttggtaatatccatacacaggagcaggatagccgggttattctgccagacaatctctgccataccaacttcaagccaccgaagttctccggtatttgttaaggcacgaagagatacaccggcatgtatctgctctccttcacgggcacgttccagaagggtggagaattcttccagatcgtcgggatggataatatctgaaatagtagactgggtaaggttttgtgaagtatacccaaatatttcagatgactttggatttgcaaaaataatcctggtatcacgaagaacaaaaacaccttcacctgcattattgaccaacagtcggtactgctcttcacgctgttttaatgcttcttcagaggctttgcggtcagtgatgtcccgggcaattgtcatcacaagactctgagtcctaatccggattggataggtcataacctcagcatagagaatcttcccgtctttcctgctgatatgaacctcatcaggacctgtcggccggcccagggcatttttcgcaaagagaacagctgtcttggtgatatgcatcgacccaatcagacccatcgtgaagatattccgtcctttcaaatcatcaggtgtatacccggtaagttctgtcgcagcccggttggattcgataaaggtacctttaatatcggtcaatagataagcttcaggcgcataatcaaagaggatcttgagacgttcctcattattttttacctcctgttccgcagctttccaatcggaaatatctgtgaggactacggtcaccgctctgatctcatcagattcatcatcctttaccggagtaaaccgccggatataatcctttgaaagccagtggaactcatcctgaacctgacgctttgtagaaatcaccctttgaagtgcctggtcaaaccgctggtcttcacctggcgggagcatgacccgcatacgtttttcaagatacttatcagcaatatccccaagtttgttccggtgatatgagttcataaagaggtaacagccttcacgatcaaccatgaagattgaatcaccggttgactcaacaacgctccggtagttggcctgagtaacctggagcgtggtaagcgtctttcgctgttcggttacatccttaaaggtccagacccggccgatgattgtcccgccaatacgttgtgggagtgtattgcgttcaaatacccggccatcacgaaactccagaacatcaaatgcttctttttccggatgagtcttgaggtaattgatcttttcaataaaagattcgcggtcctcaagctggtcttcaagatacgccaacaggacttcttcgtcccgttccccaataaccgactcaggaacaaaccacatgtccaggaacttctgattataattgatgatcttcccaacccggtcaacaacaaagattccatcagacgtggactcaaatgttgctgtaaccagtgatgcccccctggccacctcatcttcaagcctgacgcggtcagtgatgtctattgagacaaccgttaccgcaagggtctgctgcgacgtctggtatcggacagggataaactttctattgtaaaacctgccctctttctcatactcttcagaaaaataattgttatgcgtaataacctggtttaaggaatgaacgaaacgctgggtctcctcttcagtatggagatccttgtacatctttgactcataattttcgccataaataccaagtcgtttctgatgaggactgttgatgaatagatacctgaaatggcggtccaccatgtagatggaatcgtcagttgcttctacaatggtcctgaaattggtgtctgcataatgaagcgcctcttccccttgtttctgtctgacgatctgtctgataaatgtattcagccggagagtttccagttcggtttcatcattctgcagaaaaaaataatcaattcctgctttgaccgcttcttttaccactgccggcgcctgatttccggtgaagatggtaaccggactgtattgaatttgtttttttaccttcgcgatgaaatccagcccattttcttttccaagatcaaaatccccaatgacgacatcataatgagcagtctgtaatttattgatggtgtccttcacatcagaggctgcgctaatggatatcttcgccccgttctctgtaaataactgggttataaaggaaaactgctttggatctccaatagtcaggattgtgatgacagccagatcaaatcacctgaaggtacgatgaacaacataagatactctgctaaatgattaaaaccatctgctcccgaaggggtatccagatacacgggatgtaaagcattatctaaccgaatttataatccgtccgaggagatcaagcgctttctcctggttttccctgacagttctgatgatggattcataggtgatttgagcatcgcacactccattggcataattgtctacagtgcaaatagctgcaaaaggaagtcccagttccgcggcaacggtcagttcacttccgatggtcattccaacaatgtctgcgaacctcttcatccatgagatctcagctttactctccagcctgggtccacgggtttgaatataggttcctctctggattgcctcaggagagagtttcatcagaagtgtccgaagatcagcatcaaattcaggattaacatggtcgattgtgtgattcataatggtcggaaccggagtcaggcagataaaatcatcaggaataacacgggatcccggagggatatcttcctgtaatgaaccggttgatccaagcgctatgatgcgatctgcgccggcaagtttgagcgcagcgatatgggaacgatatggaataatatggggagcacatcggttctgatgtctgagaagaagaaaaaatccttcacctttaaataattcacttgtgccataaggtgtatgttgttcaaattttgtaaattctgagccctgatagtccagtaatgaagttccaccaataataccaagcatgtatgaggtcaatctattggttgtcaggaatcaaaattctttcaggaagaataacagagggaacgagtacgaaatccatcttttcgagagagatggatgagtatatatgtgataagtatcaacctaataaggcgggccggtagatcagtgggagatcgctaccttggcatggtagaggccgcgggttcaattcccgctcggtccatcagtttttacgtttttttctgacaaaataatctccgaagatctggaaaatagtgaaaataaaggatgaatgatacagggattactcatcccaagagatcacatcttatttgatgatgcatacctgcacaggtcagccagattacaattatcacaggccggatgtcgtgcagtacagactcgtcgcccatgcaggatgaagagcccattaatctctgcccagaattcctttgggaaaacccgtaccagatccatttctatccgatccgggtcgctctcgtcggtaagtccaaggcgcatggacacccttcttacatgggtatcaacagcgattcccaccgttttggaaaatgcatgatcaagaacgatatttgcagtcttcctccctactcctggtaaccgtaccagatcatccatctcatcaggcacccggccatcaaattctttcatgaccatctgcgatgccgcaatgatattccttgccttggtgcggaaaaatccggtcgggtggattagcttctccacatcctgaacgggcgcctctgaaagggcagctacatccggatatttcataaaaagttccctggtgaccatgtttacgcaccgatcagtagtctgtgcggaaagaatggtagcaatcagagtttcatacggatttttgaaatgcagaaattcatccctgctgtttaagagatcgtatcgtgaccgcagacgtgaaagaatcgtattagggtctaaatcagtcataaaagaagatggggtaacgcagatttgaactgcggtcaaagcgtcccaaacgctctaggatggaccaggctaccctattaccccgtgcgggacatatgttgaacccggtaccatttatacccttcctttttattttttgagtggaaatggattttttccattcctggtaacgagcgttccgacaaatctgcccgtttcaagggttgattccagaagagcaggatcacgtccgtccatcaccaggaggggtataccgcaccgctcaaccatcttcacggccacaatatccatgaccgtattgactcctgccacagcctgctgaccgatgacaacatctaagagttctgcaggattcatcgtctcaaagcgttttgctgcaggatctttgcgtggatcagctgaataaatcccatcaaccgcagtcagatttatgaaaatatctgcgccagtccgctctgcgagcactgcagccaccgcatctgtagtctgcccgggtgtgataccccccatcacaacaatcttcccggtttcagcagcgcagagtgcttcggtatgactggtaacgacacaggggtaggcagcctgcccgagtgcgccgacgagcaatgtcgcattaagcctggtaaccatgattccaagttcatctgaaaacgcttcatccgcctcgaaggatcgtgccagagagatatactgacgggcagttccacccccgccaacaacaacaaaaagacgatttttcgcagaaattctggtcaaaacagagatatagggtttgatattcggacgatctatatcaggaagaagaatagacccgcccagtgagagcacgatagtaggcattcaacctcatacgttacctgatcgaaagcatataggttattcagcacaattacatcatttataaaccagccaccatctttctcatacaaaacagggtaatcatggaagcgcgacactattcccgtgatgatgcgggtatcatgcattgcaatctgtgtaatcatcattgcaggattgctgatacaaaaactggtatatgcggtgtcaggagatccatacgtggccagctaatcgcagagacctatggcagggtttcatctgaagccgttgatcccatcgagaaaaaaccactataccattttctccccggaacactctcatattccctgggcggagtcgggtgtaacttctcctgcagccattgccagaactggcatatctcacacgccagttttgacagcatccggcaaaagactctctctcctgaagagggagtaaaaagggcgattgcatcaggatcatcatcgatatcatggacatataatgagccgaccatctggtttgagtatacccaggatatggccagacttgcccaccagcagggtctgaaaaccgtatacgtgacgaatggatacatgaccgaagatgctctgacagatcttgcccctgaccttgatgcctggcgggtagatatcaaggcctttaccgaggagttctaccataaggtctgcagggcgcgtctacaacccgttcttgacacagccatacgtgcaaaagaacttgggcttcacatagaggtagtccatcttatgatccctggcctgaacgattcaccggaagagaccggccgactaatctcatgggtgattgacaatcttgggcaagacactcccgttcactttaccaggtttcatcctgatttccaaatgcaggaaacaccagcaacccctatcagaaccctcgaacgtgctttccacctcgccaaggagaaaggactccggtatccctatcttgggaatgtccccggacatgaatatgaacagacatggtgcccccattgcaataacctcctgattgggcggtcaggatatacagtcggaccaattcatctgcatcatggcaaatgcgcccattgtggaaaagagaccggcatcatcacatacatatgactggcgaccaggaatactcctttttctgtgatcggatggcaggatcattatgtaaatacctccgttttatgggatatgactgcagaagcgcaaatgatctaccaccaggaaatccccgtgaagatactgatatcctaaagatcgcaggggaggagaagaggattattctgacacaggatgcagaacttgcacgacggggagaaggaaatgctatcaggcttgtttcatcagatcttgctgcacagatcagacaacttgtccaggcaggccttattcatccggagataagactgacaaggtgttcacgatgtaatgcgctgttacaggagggaacatctcccgaaaaacccaatacaccaattccagaagatattccacttgtatattgtccagtctgtaaccggcagtactgggaaggaacacatacaaaaaatatgagagacaacctgcttcagatggtgaataaaaaataaaaaattgtagcaggatttatttttgtaccataattccggatttcattctgattacaagcgacttctcttcagatttcccgctgattcctataattccgtcaatttcatctgctaccgattccagttcgtcaaatatccggtttgcatcccggcgaatctcccgtattgaatcacgaaggctcctaccccgcagatggataagacgacggtcccggtagatcatccctgaacgtgacagatttcttaaatgatgatttactcttccctgcgatatctccagcagagatccgagatcctctgaggatatcccgtcattaccagataaattctccagtattttcagaataatctgcgttgacaggttatcgatatcccgaccggatgacagacccagggtgtcgcataaccagtaggtctcttcaatcaggtcttttttatgtggacgggggaggttttggaggataagccgctgatgcatggatgagatacaatcaggttattgttgatatcatatcaatattatcgaaatgatcttgaaggaattagaaaaatatatatagaatttttaatcaacaattatgtgcatattgcatttcaaaggagttagcgtatggcaattacaccaatcggaccacgtgtcctgattaaaccttataagcaggaagagaagaccaagggaggcatttacatccctgactctgccaaggaaaagaagaaacagggagaagtaatcgccgtcggaacattcgaagacggaaaagaactccccatcaagccaggagacattattctttatggtggatacagccaggaagagattgaatttgacaaagaagactatgttatcgtcgagttcaagaatgtcgttgcaaaactgaactaggtgtcattcatgtcagcaaaacaactcatgttcaatgaaaacgcccgtcatgcactccttgaaggcgttaataaagttgccaataccgtaaaaatcaccctgggaccaaagggaagaaatgttgtccttgacaaggcaggtggcccggtcgtcacaaacgacggagtaaccatcgcaaaagagatcgaactcaaagacaagttcgagaatgttggtgcaaaactcatcaaggaagttgcttccaagacccaggacaccaccggagacggaaccaccaccgcaacagtgcttgctcaggccatgatcaccgagggtatcaagaatatcaccgccggtgcaaacccaatcgagatcaagaagggtatcctgaaggcagtcgatgctgcagtcgcctccattaaggcaaagagtatcgaagtcaaggacaaggagactattaaccgcatcgcaatcatctctgcaaacaatgacgaagagatcggaaacctgatctctgaggccatggacagggtcggatacaatggtgtcatcaccgttgagaactccaagacccttgagaccacccttgagcatgtcgaaggtatgcagtttgaccgtgggtacatatcaccctacatggtcaccgatcaggaacgccgggttgttgagtttgaagaaccatacatactcatcaccgaccggaagatctcaagtctgaaaactttaatcccggttcttgagatgatcgcccagagcggaaagccactgctcatcatcgcagacgatgtcgacggagaagcccagactgccctcatcctgaacatcatccgtggcgccatcaaggtctgtgcagtaaaggcacctgaatttggagatgtcagaaaggaagttctccaggacattgcaatcctcaccggcggaaccgtcatcagcgaggaacgcaaccttgcaatcgaggatgtcacccttgacatgcttggacaggcacggaccgtcaaggttgaccaggacaagaccaccatcgtaggcggtaaggggaagaaatcagacatcgacacccgtaagaaactgatagagtcccagcttaatatcaccgagaagaaatacgacaagaccactcttcagaaccgtcttgcaaaactctccggtggggtcgccgtcattaaggcaggcgcagcaaccgagactgaagtcaaggagaagaagatgcgtatcgatgacgcactcaatgcaaccaaggcagcagtcgaggaagggtatgtcgccggtggtggagtaaccctcttccgtgcaatcaaggcacttgaatccatgaaggctgaccctgaacagatgatcggtgtcaacattgtaaagcgtgcacttgaagaaccactccgccagattgcagataatgcaggtcgcgagggagccgaagtcatcgctatgatcaagagcaatgcaagcgagacctacggatacaatgcaaagactgacacctatgaagaccttctccaggcaggagttcttgacccgacaaaggttgtcagatccggtcttcagaatgcagcatctattgcaggaatgctcctgtcaactgaagcagttgttgtcgatttcgacgaagaaaaagataagacatctgctgcaatcatcatctaatcttttttttagattctgatcacatttcacattctgaactttcttttctctcgttcctttgtgttcgtaatatacatcaccccaaagaagagggcgatacaaaaacacagaactgcagcaatcaccagtttccagtccatatcagcagattctgacgtcatggccataccaacaaatatcagaccgatgatgcatactccggttatttcaaaggcatataaaaaccgttcaccgagctggaccattgtgctctattctcctgcagatcaaatattttatacctctgatgaccgtataaacgttccgtttgtatccatgaagatccagaacgaggtaaagggggagatattccgggtatctgagaacctgccctctgctccactaataatagccggatcatactgctgcgtggatacattaaagggaagaatgctcacccatgatgattcattcggggaaagaatgtcacgggccgggatctctttcagaaaaggtgatccggcaagattccatcccttttccacaggttttgtactgtttgagttcatattaagaacaaggggcacagataccggtgcatcagagtaaaccagaagtccgtccagaggtgccggagagatctcagggttttgagcaatccatccaccaattcctttgtaagtccatatggtatgaccatcggtattgacctttgagaagagatcacgacaggtcttctgggatcggagcggggcagggattgagacaaagttccagccaggtaccagctgcagctcatgcagggttgtatttcctgaaccaagagtccgtctcatctcacgggaaccggtgcctgaattaaatgcgatgagggtcttttgcaacgtcagatcctcagcggccttcatcgcagccggagcattcaaaagcccgtatccatagtaaatatccctcccggttctgcccaggtcagttgctgatgactgaagcagagagcggatttctgcagacgtcagccccggatacccgttctttatgagagctgcaacccctgcaacctctgcagctgcaaatcctgttcctgtgccccggcaataggacgtgttcagacatggagtgataatgtcctcacctggtgcgacaagctcgttatatatcccgtaattggaaaagtatgataaaccgtccgttttcgcaacggatccgactgatagtacatcaaaatgatcagaaggataatgcatggcgttggaatcctcatcaccagccggtgcaatgagaagaaccccatggtcctttgcataagctatggcccgatcctcggctcgtgaaggttcagtcccgccatatcccatcaggatgatatcagcaccggcatcggttgcatgagcaatagctagagcagaacgggatgcggacatatcatttccggttaccccgattcgttcagggattaaaacaagtgaagagttggtcgaattctgtgatacattccctgcgatcagggagataactccacagagagcagtcccgtacccatccgcatcttcaggtctgctgtcctgccctgcccagtcatagccctggtcaatgggaccgacatccggatgagagagatctaccccggtactaatgactgcaactttgaggaccgatgtattaagacccgaccgtctgaccgtatcaaccccggttctgacaagagcccactggtcaggagaactattgataatctggtcatctttggtgacagatcccgacttgcgctgtgcatcctgctcaatctcatgaacccacggcaggtttaacagttcatttgtgacatattcggtctcatttggatctgtatcgactgcgacaaaaccaagcaggggagaccggagagaataggtaacattttcaggaagcgggacatcaggtggaacaggttcatagccaccagtctcattaggagctgcatacacgataagacgcacttcatcgctatcagcgccggaaacctgaatgaagagcccacagaataagagaataccaatgaaccccatcatcactggttttataaagcatccgctctcattcaggcaacccaagttaagccccaccatgtatactgcccgagtacttcaacatctgtatcagggagacaaaaaccctctgatttgtcagcagccagggaacaaaattccaggccggttcatatagatccaccaaccttctgacggatataataaccgtgatggagaataggttcctgaaccaccatttataatggaaggcctgaattcctgggtcctgggatcaaagaccaaaaccgtagtccatgcatcggtaagcggggagagcagatcccgtgcagtgatactctcccgtcctgggaccccgaccgggttccaccccggatacagttgcttcaccgtctggttggtcccggttgtatcaaaatgcaggttgataccagcctcctgttcagaatatacccagaccacatccatctgaaggagagtatcatttgggcgaaccacactccagaaccctcctgccggattatagcgccagatagaatggcaggcagtctgaaccgggttgaagatctgtgcggtttcattccccctcgtaagtggatagggaattgataccatattccatccaggatagaggagcagtttttctgctgcatcatacatccgtggctcaaaattacacccattcatcaccgggtacaagatattccctgatgtgttctctggaagtgacaggtttgttgcaaccggtatccccctcccatatacgggatcccaagcatcagtagatgtaccggtcgcattcagaattatcttcctgacttcactctctttcatacccaaagacccactcataacaagagctgcaagccctgcaatatgaggggcggctgcactggtcccggtaaagactgcatgttgcattgaaccggtcagaaccgtgatatgatccggcgcaaccagatccggcttttttcgaagctcatagacagggtacctgataagtgccggcccccgggaagaatactcctgaacggtgagatttttcccgccaggtgccgcagcccccaccaccagagcctgttttactgcctgctgaccaaaaacagaatcttcaggagtgtacggatctaattcaactgatctgcctgataagggaaggacatagatctcgagcagggcatcctctgcagctgcctggacaaccttcacggtaaactcccgtggtcggtcagcagaatttacaaacctgacccactccatgggatcgtcatctccatcctgaatatttacacttcttgcaatctcccgccccgagtcatcatacaggaagagatcataattgttcgccgatgtgccaaaccgatcgtcccattgcaggattacatgcccggcaagacctgatggaacggtaaatttcatgtctcgtccggttgatccctgaaaatcctgccacagatatccctgatcctcgtacccgtgaaatggagcctggtaatgctcctttgcaaagttaccagctgcagtaatatagagaacattatacgaaagaacacggtcgattatattctgactgatatacccgtcctcgaaaaatggttccacataggtgatatcatcgcaaataatgttacaaccatggataatcagctggtccagggcacggacaaattctatctggcttgatccccggtcatgaaagacgagtgttgcattcggagcaatatcatggatgatctgcagcatggcaagtccttcgtcaccgccaacagtatcagatataacctccacatccgggagttctccaagagccttcagatcttcaagaccatcaaccccgtctgatatgacgccgactttgacaccttccccggacaatcctgaaatattacgaaattcccgtgtcttaagcagataatcgccctcggtcgttattttggatgtccgggggggtatctgaacaacaagggagagtataccatcctgcatggccagacgggtgatattatctgcccgtatccatcccccgatacggccatataccgaatccgcaaccggagaagagaaataatccaaaaatgaggagggtgaaaaggaagggctagtcttcgccgatatacggacctcaatatcagcatcccgaatcctcacttcaccggtcttttccatgagcgccatcatatctgcccgtgactgtccgggagagaggtaggtatcatcaagaagctgcaaaaggtcagtggagagttttttcttccatgaattttcaggaacaaaaactgatgctggttcatccagtatattctcgaatgaccctgaactggccggaggaattactggcatgatacttttaatcccgctcataccagaaagaagagtcaggttttcagatgttgcccatcccgtgacaagatgataggatgtgtcctctgccggatgagaaagcaaagggaggatattttcacttgtctgattcttctcaagttccaaaaggatatgaactgaccaggtaccggtctcatttctccgtatctgcccgttcttctccatgttgtctatgatgtcatcaggcgactgaccaggcggacaggaggccttatgtaagatctgaagaaggtcgctggacaggatatcggatgcggagttgtcgctcactaaggctttgtctgcctccccaaacccgcatatagaaaatattgtgagtactagtatgacgggtaataaaaaaaccaaatccttttgcaccggcccaccagtgagaaataggtttacctatgaatcataagaagtctttcgccatatatacccttattttactaggagggcaaaccttgtgacatggatgttgagggttatgcccgccggaatctgaagagaggcagggcgtcccaggatattatatcagatcttgctgaccgtattgttgagataaaagggaccagcagggaatatgctctttcctttgcacaggcggtcttggtagaagtgaccgctacctctgatcttacgagcgacattctcacctatgaaaaggccggtgtcactatgggtgccttcggagtcggctcacgagggaccggcgacttttatgcacaccggaagatagcagagatcatcggaaaatcaggggccaccgtgggagtcgaagatatggatgatgccggtgtggttcaggccgggggtcagtttattgtctgcaccgttgacgggatgcattcacgtctctcagattttccttaccttgccggttttcatgtgacccgtgcgacccttcgtgactgctatgtgatgggagcacgcccggtcatgttgttttctgacattcacgttgccgatgacggggacgttgcaaagatctttgattataccgccggggtgacgacggttggagaactgaccgaggtgcctcttgtcagcggatcaactctcaggataggcggggacatggtcattggtgaccgcatgaccgggtgtgtcgggaccgtcggagttgcagaccacatcaccgcacgacgacaggcggccccaggggatctgcttcttatgaccgagggtgccggaggggggaccattgctacaacagccctctactacgggtatcatgacgtggtagatcggactatcaaccttaccttccttcgtgcggcagatgccatcctgagaagtaacctgcttggttccatccatgcaatgaccgatgtaacgaacggaggacttcggggagatgttcacgagatggcaaagactgccggtcttcggttcattgtagaagaggaagcagttcagggacttgtcgatccacacgtttaccggatgctgatggaccttgagatcgatccgcttggcgtatccatcgatgcccttctcatcatcgcccagcctgatgtcatctcaaaggcccaggccctgctctctgatatcggggttaaatcatcagtcataggccgggtcgaagagggccgggctgaaccagttctattgagaaacggaaaagaagaggaatttaacccacggttcagagaggcggcatatactccgctcaagaaactggtagagaaagaacaacaggattttgaattgatgaaaacggaggttgaccgggctgcacaggccgctatagccaaaaagatgcgggtgatggaaaggctcaagccctgatctttgcctcacatcatccccgattaccccgaatatacacagtacggtcaggaaagccaaaaatatgtcatttttaatcatactttttttaccccgttaaatatccttcagtcttgagacttatgatggattacaaccaagtactacccaggtatacatggcatatgtccaccggatagaagtccaatataaaaccgatcccagactaaaggtcagaactgatcggatccgttcacttgggtttcccattgatgaacttcatgtgatcgatatctataccatctcaacgaattcacatgactttagccctgaagaactgcgtgagatcggaactcagctcataaacccggtggtacagacatgtaccgttgatacggccacaatcgcacactttgatacggccattgaagtcgggtttcttcccggagtgaccgacaacgtaggaacaaccgcacgccagaccatcgaagactacaccaaacgaaaattcgggccaggagaagcggtatactcatctcagctcttctttgtcaaaggaaggctttcaccagcagcgattgaaaacctggccgcaacacttgccaatccccttatcaaccgggttcatataaaatcacgagcagagtacggcacgacagggatggacagagttgtcccggttgtcagcctgcacgaactcccgactgctgaaccggtagatcttgacgttgacgaccaggaacttatcagaatcggaaaggaaggcatcatagacgctgagaccggacagagaagaggcccgctcgcactcgatctggtgcagttgcatgcaatccgtgactattttcaagctcaggggagaaaaccgaccgatgttgagatagaatcactggcccagacctggagtgagcattgtaagcatacgatctttgcctcaccaatggacgatgatatgccaagagggctgtataaaacctgcatccaggcagctaccaataccatacgggcacaaaaaggcgacaaggacatctgcctgagtgtcttctccgacaattcaggggcgattatctttgacgaccattatcttgtcacccataaggtcgaaacccataactccccgtctgcacttgatccttttggcggggcactaaccggcattgtgggggtaaaccgggacaccatcgggtttggtctgggagcaaagccctgtatcaacatctacgggttctgtgtcggcgacccggagagcaatccggtcctctatcgtgggaaaaataggtcaaatccgatcctctctccgcgacggattcttgacggggtggtgtcaggtgtcggtgttggcgggaactgttcaggcatccccaccccccagggatttgtctggtttgatgaccggtatgttggaaaacccctggtctttgcaggaacggtcggcataatgccccgaactgacggaacacgcaagctctatgagaaacaggcacggccgggagatcttattgtcatgattggcgggagggtcgggaaagatggcattcatggggcaacgttctcctcagaggcactggacccgaaaagtccggtcaccgccgtccagataggagatcccatcactcagaagaaattatccgatgttatcgtcaaggaggcccgtgaccggggactgtataccagtatcaccgataacggcgccggtggaatctcctgttcggttgcagagatggcaaaggaatgtaatggatgtcatgtcttgctcgataaagtaccgctcaaatatccggggatggcaccctgggagatctggatctctgaatcacaggaacgcatgacacttgcggttccaccagaaaaactggatgaattcatggacctcctggccagccgggacgtagaggcaacggttatcggaacattcaccaacaccggccggtgtattgtggagtatcatggatctgtcgtgatggatatcgaactctccttcctgcacgacggtgttccggtaaaacaattaaagacagaaccaacagtcccggttccatcagatcccatgccaccgtgcccggaacaactggatctgatcctcaaagagatgcttgcgagaaagaatatctgttccaaggagttcatctccatccaatatgaccataccgtccagggcggtcatgttcttggcccggtccagggaccaggacgagtgcaggggatggcaacccttatgaaagtagttcctggttcaaagaaaggagtgggtttatcacagggcatcttcccgtcctactcagagattgactcctaccggatggcgattgcctgtattgacaccgcgatccgtggtcttatcgcccttggtattccgcttgatgcgatagccattcttgataatttctgctggtgttcttcagatgatccaaagcgtctggcccagcttaaagcggcagctcgtggttgttatgacggggccaccgggtttgagacaccattcatctcaggaaaagacagtatgttcaacgacttcaggggatatgacggggagagtaatccggtgctggtctccgtgcccccgacgctccttatatcctccatcggtatccatccggatgtgacaaaagcagtctcccttgatgcgaagatcgaaggagatctcgtttatctgatcggagagaacagggatgaacttggcggttctgaatacgctgctcatcttaatatctccggtggcatcgtccctgccattgatattccagccatgaaggccagataccatcgactcacccatgctattttacacgatcttgttgcatctgctttcccggttacccacggaggacttgccgttgcccttgccaaggttgcaatcggtggaaaacttggtatggatgtcaccctttccggagacctgcgatcagatgtccttctcttttcagaaacactcggacgatttattgtgacggttgatcctgataagaaacgatcatttgaactggcaatgggatctgacgcaacactgattggcagggtaacggggaagaacctgcagataaccggcccctcactcagaatatctgttccggtcagtgagcttgaatctgcgtataaaaaaccattcggagggtactaatcatgaatccgacagcgacacgacacgcctccggacagaaggagcaggagttgatcccggataaggcgcttattatgagcgggtacgggattaattcagagattgagaccagggaggtgcttttacgtgccggcatggatgctgacatcattcacatcaacgatcttatcgaccggaaataccggatgtgcgattatcgtcttttggttttccctggcgggttctcctatggtgatgataccggagcaggaaatgcctatgccaaccgggtcaggaataatctttggaatgatgtgaccgaattcctcgaggaagataacctggtccttggtatttgcaacgggtttcaaatcctcgcaaatcttgggcttgtaccggcatttaacaagcagtacaaacgagatatcgctctcatgccaaaccggaagggggtgctagaatgccgctatgtaaccatcaaaccggcttcagaaaccctctggacgaagggaatagaacgaatcgtctgcccggtctctcatggagaagggaacttttcctgctctaaggaagtgcttactgagctcaggagccaaaagatgatagccttcacctactgccgggagaatctgaaacctgccgacggagaatacccctacaatccgaacggctcggtcgcggacattgccggaatcacttcagcagacggaaaagtccttgccatgatgcctcaccctgagcgggctatggagtttgtcaatgaatatgactggccattacagaaagagagacttcgacgtcagcagcagccgattccgaccgaatcgatgaatatgaaactatttcgaaatatcgttgagtatttcagataattctcacagaaaaactgtccctttttcagggaggggaatctccaaaatttttaaccatccactaattctaatcaaaaatctttcattttcgagtaacttattctaacctataccattatgtatttgtaacgtaatggtaacctatgcgaaaagatggtacatgtctgctgattttttctctttttctattttccctttcatctccagggggagtttcagccgaaccaatcgatgcacagaacacagatctctgggatatcgttgaagatgcctatgtatactgttacccattggttgtggttgatgccacgcagaaaaaatttacgaacactgaggtcccgaatcccacacaggcaccgataaaccaactggcccacagtaattttgtgtttacagcagaaaacagacttgttgtttcaccgaacgttgatgatatctattcgagtgcatttctggatctgaataatactgcttttgtttttgtgaaaccaccaacctatcggttctgctcagcacagtttttggatgcctatacaaacaccattgatgtggtcgggtcagggagcaagacagataatccagaagatgaagtcatctgtctgataaccggcaaagattacgagggagatgttcctgacggtatgaaacatatcgtgataccaacagacatggcctggatcattatccggactgtggtaaacgggccttcagacatcccgaatgttacagcaatccagcaaaaaatgatgctggtgccccttgatgtatacctgaataacgagatctatgtcccggaaaaaggaacatataatgagaaatacaacttcaacccagccgaatatgtattcaacatgtcagctgaagagttctttaccacggcaaatgccctcatgataaaaaatcctccctcaccggatgacactgaaatactggaaaaaatgaagcagataaacgtcggaccaggcctcatctttgatgctgctattctgggaccagacgggcctgaacggtggaattccatggttggtcagatcgaatctgatcttatcagcaaaacaaaagaatacatgaatgctcttgatggttggaaattttatggcgagccaatcggagaatggggtactgtctatgcgtaccggggactgattgccatcaaaggacttggtgccaatcccacctatgtagctatctatcctgaggccgattcagactctgatggccagatattaactggggctcatacatatcgccttcatatcgataaagacatgcttccaccggttaagaatgacgggttctggtcttttaccatctatggaagtgataactttttaattccgaatgaaattgaccggtactgtatcaatgaccgaagtaatgtgaccttcaatgaggatggatcactggacattctgctccaggctgacaaaccagctgaggagatgatgaataactggctaccggtcgggacagcagattttcatatctatttacgcatatacgggccagatctggagaagataaagagtacctggacccctccgaaaattgtcagggttatgaatgatgaaaatatttcagacgataattctacagaaatccgggaatcggtcgtagaagtatgagataaccgatttcattcctgtttttctgggcttttcatatactttatgtgggttagaatcattatcagaaaaaaattcaaccgatttttaagatataagcctacataaacccttttgcttaacaatcctcatttaaacgaaatggcaaatagccatctctcctgattatctgccttggaaaatcaaataaaaaagaaaatttatgtgattctgtaaaatttatcaattgctacgcttatcggatcattatcagaaagatatgtcagctcaaattcatcaggaccgatgatcttcccatttgaatatccgttattctgttctgcaagtgataactcagttccgtctgcactgatcactccggcaagttcacgggtaacttcagtaccatcactcttcttaaacgaggaatatccgataataatccggtccttctgctcagtaatattcagaaagaataatccgctttctacctcagaaaaaccctgaccactcttatattcaacatacggccctgtccagttcccgaccagatccggaatgtctgcggtcgttattcctgccataccaacaatcaggcccaacagtaacactgccattaaccctttcatacgatagaatcactccctgaaaacatataattaccgaccaaccccagataatcagaatcagacacattcaatatatagatattagctaataactcccttccaacaaattaagttttataaatactatataaatttgcgatcatcaaaggggggtttttagatatcctctataatcggtgtccatactatctctgaaatgtcatgttcaaccgcgaccttaggaaagtattgtagtgaaaaaagaagaatcgagcgtgagttttcaatttgattaatttttagcgaaattctcaatctcttaaaaaaggttgaatcatatatgctaaatgggagaaaaatatatgctcatctattcctgtctttataatgagtcttccgctcatgcttgtcttatacccaagggtacgttcatggggactgttctggaccgatgtgatccggcttgaaggaatcagactcaattcggtcagatcgtatggtcggataatggtaatcatttcagggatatgcctgggctatgccagagggattattaattgcctgtatttttcagggagcggggttctgtccggtggaatagggattgctatgatccgtatcggttcacgaatttaaaaaaaggtattttaccagtaatattcacattcgtaataacaatcagaacaatcttcttcatacagtatgcagtcatcagattcatatgtcagatcatatgaatcacaatcacaggatccgcctccttctaatccaccataattatcatcatacgttcctgaatcactctcaaattcgatcgtataccgctgatatgctgaaaattggcttccttcattacatacttgaaaggcctgacattcatgaggagcaatgagttctgcaacccagggacggtttccttgcggattgtttacataacatgtatagactactttatagggagatccagatattgcagctgtttcttccttctggcattcaggaccaaggtattcatttcccttatctgctggataatatcctccacctccgcgggtctttaatgacttaaatccaggataatagggatctactttccaggtgacagtgagccagccggttgtcggaatttcaaaattagctttaactcgttggactggattatcagaagtatatcttcgttcttttgatgccagctcaagatcgactaatgttactgctgtaacaggaaaggtcacgagcataccgagaaggatgagaaggaaacaataatatatcatttttttctcaggtaatacattcatagacatatcaccatcccaatcatgtatatgaaaaaaaccgaattatctttttattctccatgaagactgaagatagtaatcagataaagactcattttttcatataacatatcataataccatttattatttaaatgttttgatgcgaggaggaatatcattcgctataaaaaatttacgaatattgtactatattcagaaaatggtaatgtgggtctaactcttaataataatgtttgcatataatacagaaaatacctgtgagttcctcatggcccaatcacattgtataagagaggatatgatcttctcacgcctcgccggttgagtttccaagaggcactaataccgcctttatgttcagaacctcatcatggaacagggtgaacgatcgggtataatcaaaataccccggatatttaatgaccagttcattggccccagactccagaccaaatactttcaacgagttcaaatttcttgttttccccttatattcaccattcacatacacatccgctccgggtggtgaacttgtaatcaaaaatccggtgttttgatagtaattcgattgtgcactattggtatccgaaccagagggtttgagtaaatcctgaatatttgaaatttttggtgtcttgaacatatcagaataatcaaacgttggagcatgaatgccggtataataccatgtggatccatacccgagatggtgatcaagataatatttgaaccagtcaatttggtcttcatcagtggcagctgaaaccaggcatcctgctatgattatgaaaaaaagtatacacaaggcatatttgatcattgatttcaccaacatcacttgttgatatgaatgtattcgtgactcaatagtatttgagagttacccaacttttcatcgaaaatttacggccatttccggtgtcagagattagccaggattctcatgcgagcagttcattgcaaaataatatgcgatattggaaaagagctccatttcatcaaaacctgggaagcgaaattattataatggtatcatgatgaaaaaactacttcattgattttctcactcgaatatcagaaaagatgctaaaatggctgaaatcagtcagcgataagagatgtaaaaaaggggaaatttgattatgaatcagaccttacaactttgaaagaattgcttcaatacttttaatctcaccctcatttaccgtatagttaccagcataatccttgtatcccggaaaacttatgctcacattatattcacctggaataaggccttttacttccttcgcctttaatgagcgggtaatacctacactttcaccattgacaaagatctctgctccgggaggggtgctggtaatgctaaacccggtgttcggattatatacacgctcggtattcacagttgaatctaaagtaaagtcagtttttaacttggttccccaggttccatagtaatcgttataatcatagtcggctgttacaacagataccagacaccccatgataaacaggagtccgaacattccaatactatacttgatcatatgatgcaccatacattttccccggttgaagataaggtttcttgaaaaaatcggaggataatcaactttctggtgtgacgtttcccatttacgctcagtagaattttttaatcgttaccagggaagggagaggagcatgaaaagaacggtagttcttcatacttcgccttcatatcaagcaggaataggaaaattaataccttggcggataaatgacattcgaagagacatttcgttttcaaactcatcgggagtaagaagaatgtaatcaatttgtttacggtatattttaattacttgacggataggttttttattgcttttcttctatcaagtgagctcattccaataaatgatggagaaactattgcaagatcaacatcactttcgttcgttgcagttccttcattgtgtgaaccaaatatgatgatagcattgagcttaatgtttttttttaatttcttcagataaatcttgtattaaagattcaatccacgaatccatgataaaaaatctccggtatcatcaattatcatctgtgcagtctcttcagaaatatcattgacgagtgtttcaagcattggaagatatcgtatcttcacgcttatatcctctaatagatctatgaaattatcatacttttcaggaattccaccaggaatagtttggatcaaaaattcaagactatgagttcttggaggttgtgtctttgaataataaagatacagcgctttcaaccccttttcaagcgtcaaatgacaacaaaatattgctttaggaaatcttttccttgaaaaaggtattcagcatcttcataatcttattctgcctgaaatacccattctaatacttcaggatccattattcatatatccttgtcaatggtaagataaaattgttaatggatgaattttctttctattaggccagattctatacaattagatccatctatatacacgaagccgatgcagatgaaccggatatattagtactattccggaaaattatcgtcctcatgccatcaggagatacaacgcatcggacatgaacaggttttagagaattatctttgcattgaactgagcacatgatctcctgatatgccatttcaggcaatcgctcatacatatgcatcaacaactcccggtttttactatcaggactacttttccggacccaggtattccattcaggaatatcatcgatggtatatccaaattcagagataaacgaaggattcaggtaggttactccaccagcatagtcggtaatgagaaccggatcaccaatgtatgcgataacatccaggaaccgggattcactcttgctcatacactcctgcgtaagtcttctggcaatcgctatggaagcctgacgaataaatgactcaataaccatatggttttccagttcttcatcaggccgaagacacatccctacaaacccaaagagctggttttgccaggccagaccagcgatacacatcttccctattgattgctgcacgataaaggcttcacaaacttcccttgaaaatacctcactacagatatcataaaaagaaagcggttcatacggaaaaaagggccgaaatggaaactccctcataatcttcatcgtttcaacggtctcataatagggaggcttactcatatattcctgaatgggaaaaacaagaccggatacatcattcccgttattgagctgtcttgaacattcgaaaaatgatgcatcccggattgactcgatcttgtaccctttcttcaatggatcatacgaaacaacccaggtccgggggggtttggggaggagttctgaaaccttgtcggcaatatactcataaatattcgcatcggatggcagatcaaccagttccatggcagtatgagctagaaattccatatttttcaggtattttttcgtatctgtaatatcctcaagaatgatagtaagaccggtatcaccttcgtcaaatattgtttgaataacctccacttacctttcgctgatcttataaggtaaatgttaaattataaagcttaactttatatctgagaagtgtacatatatatgggatgatcgctccgacacatcaaattgaacacatcggcggaatcccatatatctttgaaacattaaaagaacttcaaatcatacgaattttgaatgaggtatattcgcctcacagaaactgggtgggtttgccgattggtgaaacgattgccatttggatctgctactgcctgaccgaaaatgatcatcgtatgtgtcccttggagaagtgggttactaccaaaaaaaatttactggaaaaattgattggttttcaatttagtccaaaatgctttactgatgaccatttggctcgtatattatctctattgcacaataatgaactttggaaccgatttgaatctgaattaaatcgttctacactgcgtatatatggtttaacggatgaaaacatcgtccgtcttgatatgacaacagtaaacagcaatggaattatcgataaaaacggattaatacaatttggcaactcaaaagatgacgcctccctccctcaaataaaaatcgtactttcagtgcttgatgtgctgggtttgcccctcaccgttagtgtagtccctggaaattgtgctgatgatcctctctatatccctgcaatggaaaaggtgaaaaaatctacgggacaatctggattactttttgtgggagattgcaaaatgggtgccatagcaactcgtttgtatacgactatcaataatgacttttatttatgcccgttatcagaagtctctcatcctactcaggaaatttattctgcaatcatagcacatcaggagtctaatctttccttcacacaagtttcacgatcgtactatgatggaagcgatgcgattatagccgaaggatttgagaaaaaaatatctcattcaatggaatatgaggggaaaatcataacctgggaggaacggctaatctacgcaaaatcatttgctcatgcaaataaattcagattatcacttgaagagcaagtaaaaaaagctttctttgagataaattcaatgaataaaagaggaaagggaaagaaaatttaccgaacaatcgaggaagcaaaagaaaaagtacatgctattcttggagataagggattaacagcggtattcgaagttgagtatatcgagcatattagtaatactccaaaacgaaaatacggaaacaatcccgccagaattgaacaatcgacgagaattgaggttaaaccaactattaacttgcaagcccttcaacaagcgcaggaattatcaggatggagggtatatgtaacaaataaaccagaaaatgaattatcgatgcaagatgttgttctgacttaccgtgatcagtatatcatagagcatcaatttcatcggctgaagggaaaggcactttcacttgccccaatgtttattcaacgagatgacagaattgatggtttagtgaagtttttgactattgtaatgagaccacttgttattattgagaaaaaagtcagggattcgctgaaaagtagaggtcagggtttgagtggtcttttcgaatataatccaacgaaaatagtaaataatcctaaaactgaaagaattattgagtttttcaaagagatttatttgttagtttcattttatggtgaacaggttttttacacaattactgggataaatcaaaagcatcgagagattttaaatctgatgaatgttgatattagtgtttatactcaattgggatcaattcaggaatctgaatttaagatcagcgaacggtgagctccattttaaaaaagagattatttttttcggtggagtagcggatctcattcatgacatgatcacctttcgtcgaggtaatcgtcgcaacggattctggagatgagacgactggtatcatatcctcaatgatatgccgcccgatgaggtcttctttctgcatattacaaaactgtatgaaatgctcatttgcctggacgatattgagattatcatccacgataaggatcatattccgggtaaaacacaaaaaagcagataggggaatccgttgtgatatccagtagacgtgggctgaacctattgtttttgattcaactttcccttcggctttcagaatattcagacatcgggctatactattgcggtccttatgaagttttttcgagagatcggttatggtcagtccccggggatttgacttcaggcttttgaggaccagacttggaatatcggtatcctctgccataagcagagataacaatctttgacatgataatctttgtgtttataaatatttataaataatacaggatgagaaaaggcatttgatatcagcttatgactctcacctggtcccgacctggttcagctcagtccagactttgtccagacctgatcattcagataccatggtgaatgagaatcattaatacgggagaataacagttaccatcaagcatgatttatgaaaaaaaaatcaaggtattcatcgttttcttaaccccatcctgtgtagcaatccagttatgaccagctgtgtggctgaatatctttctgccggacaagtaatcgatcttccgaattctccccctgtatcattttcagagggaatgtagactcttgttgaagatgagattgagaatgcaggcattccagggatccttatcgaagtcgttacaccagaatggacatggatgagtgcagcaggatattgttctcccctatccagtgaatctctagactcagatatgcgttttttgattgccagcgttacaaaattggttacaagtattgtaattctcaaactggccgaagaaggaaaattatctcttgctgacccgatcgaaagatggctgccagcatacttgatggatagaatcccaaacggaaaagaaatgaccatccgccaacttcttgatcataccagtgggatcgctgactatgataaagaattaattaatcttgaagaacttcataatcccgacgttccaataccctgccaggtaagcattgaacaaggtctcagtgccagcccactcttcagccctggtacgaattatacctactcgaatgtaaattatattcttctcacgctcattatcgatgctgcttcagggattccatacgaggattatgtcacacgaaacatcatcatacccgccggactcaaacacgtttattcagcataccaatcatacacccggcccacacatccgggcgacaatgccaaaagaaaacgggacgataaatgattttaccgacctctatattctgtttgaccggggagcaggtgatattgtcagcacagtgagtgacatgaaccgtcttcataaagctctccggcagggggacctgttaaggaatgaatctattgcagatatggaaaaaccaacgccacaatatggtaaaaccggatatggtcttgggtataccacgacccaggtttctccactggatattaccattcagggacataccgagggatattcaggatcattctccttctggtattatctgcctgaaaaggatacataccttatctctgacctgaactctattggaacagacccgaatgcgatgaagacgatccgatcctctatcctgcaatatctgaaagggaccattccggataaaaataaaaagcagtaattggagagagttcctaccggatttttttaagaaattagccgttactgttcatgcattcttttaactgcggtgtatgtatcgatgaatgatgtgagtatccggaatcctctttccgtaataatataatctccccgttcatgcctttgaatgatcataccggcttgctgtaactttcttacatggaataataaatttccacccctgagtctggtcaggtgagaaagttctgagaatgtttttgtctgctttgaaactgcctggattatttgaaaccgggtaggactcgcaaacggttcgatcatctgtgaaacgatctcttcatcagtaatctgaaccagtgtaggttcgttttcttttttatccaggatccctaaggatctcataagatcaatctgtttattgaataatcgaaaaacttcggtaaaacagatatcacatttgtcaaatggtcctttctttttcaactcaacaagttggttttcgtaggattggacaatctcttcggtgatttccccatttttgatatgctgcgaggtggtagtgagaaagtcaagaaagatctgaaaacaggtatcatgcatcttgcattcatgaaccatggcatgagaaagacagtctcctgctcgttcaacctgatgatgtgccagtaatccggagtattcattcctgatatctgaaataatggcgtttacatgaatctgattggtccgttccataaaccgatgaagatcttcacggagtgaatgaatctcctgtttaatagaatcaagaggaagatgagtgtccgatggattttccatacctaccatcctgttagactgatgaggagataacttttcgagttaggaaaatataccaccagccatattagtcattttaataacgctcaagtatatttattcaactgatgatgtagtattggtgagacagatgccaacatggaaatgtaccggtacagaagttacggcagagaaagcacaggaatctctagataacatcaagtctgcctgcttcggatgtcagatccatagcaatgactgcccaatttctcatgctgcccaggaaattgcatgcatgattgaggagtgagaagaatgacaacagtaaaagaccagatccatgcacagatatcaggagcacttgcaaacgcctcctttccgatagatacgccagaagcattacttgcagcgtttcccgcaggagcggataccacctgtcaggtgggagatctgaagatgaccgccggagaagcaggaaaactccttattgccactgatttcccctttaccagtgcaaaacaggtagcagacattattgttgagcgtgcggggttatagatcccgaaattcctccatgtttatttatttttgtctaaaatctactggatttttactcacgtttcatcaaccgcttacatctgatgaagaagcggtattattacatctcaccttatctttgatgatcaatggaaatccgccctgataagaatcggaaatatttttaattttatggttcaatcgagaaaaatagaaaaaggggtgatttttacaaggattttctcataatcaggtacgtattcccaaactcatctgagtatctgtcaaagatgtcggtttgctttttcaacccatcaattaccatcagagcgtccttatcgtctgcatattcttcttcaagacctccaaacctctccctcaattgtccgtagaaactttcctcccatacttgtgaagggagccggaaggaaccaaccagttctaacccggcattccggactatctcaaatccttcatcttcggttatcatggtgggatggaattcggcgaagaattcccgtggctcttcggagggggtttttgtaaaccagaatatatccgagatcatgatatatccacccagtttcaggaattttttccagtatctgacagcttgttcgataccgatgatggatgcacatccttctgcccaaataatgtcaaaagactcctcttcaaagggaagattatccatagatgcacagaccgttttaatccgtcctgaaaacccttcgacaattattttttcttccaacgtatcgatatatggctggtggatatctaccgcccggatcctacaggactgacacaggcgggcaagggccatcgtctgtgcacccttcccacacccgacatcaagaatctcaccacctcctggagggaggtctgtgataaataaaaatgcctttttggtgtgctcatcatcgcccccacccagtctggggagagattcaaaaaccttaaatactgaactggtgtccatatttttttaaatcttaacattttaagtagtttctgttcctttcggcagaggaacgtttgttttctttaaaacagtctgtatcagttattctgatctgaatcgagactagccgtaatatgaggagatggtgggatcagaataatccattatgctactgggaataccatatcggaaaccaaaacgctaattttctccagtcaaaacccagatagatgagcaaataagaactggaagatatcctgaaaaacaagattttaaccaccatggagaagaccatgcgatataatgcacgattacgaaaagaatacccccgctcactcatccagcttgcaggcacgacgatccgggcaggggcagtacataattatcgacggacacgaatttattatttatccacagataaactgagccagcgatgtcgtataaaaatcactccttcttctctttattagtaatactcagagagcaggcagagtttatgacaaaagaatcagagtttggaccatcggcaagaaaccccccttcaacggttagttcctcatatatccttcgatattccttttcgtattcgattcccgcctcttcctctttacctggaataaaccaatatcctgaacaaagtgaaggagtagatacggatcaccgcaattcgagatctcgtttaaatgaatcatgtatcccatcaattatatcacgggtccgatattcatcatgaaatttcccttcgattttcttaacctcttcggaaatatccttcatcccaacgactttcccatgcagtaattcaagatcccacactgtcccatatgctgatggtttctgaaatcccatatggacataatgatccctcttaaaatccgttccaatccggagtaaaccggtatagggaatgtgaatctgaagacctgcatattcaaatgcatcatatcgtccaggggtcgcttcaatcccatgaatctttggataatggccacgaccatcattcacacacaaggtatccagatagagagcatcttccacaattttataggcacaataaaatccgcgatagcatgcggtgtgcatcatttggggagataatccatatgtttcaggattgaaaagcccgatttcgtcatcgtagccttcaaatccaataagttcatacgttttagtattccaaatgaccgtatccggtatttgtgctgtcatagtacccgtgatgaatgattaggaggcaagggataaaaaaatttggagattgtaaaatatccattgcaggttctccctaaattcctccaaatagaggttcttaaatagattattctaaagtagaccgaaaagtccagggagatgggtagaagcaaacagaaaaatgatagggtacgcgtcgatacggtactatccagagaaggttcaggagactcttatgcttatgaaactttgcatatactcatggatgggaaagtgactgtattagacgtaccttttccataagaacattcgtctatcagaaaggaggagagatagtattttggtaagaatattataccgaagatatcgtattgatcatctcatcatctctcgcacaggggatgaaactacctcctgacaccaggaagaactcatgattgaactggtagtcagcctctttaagcggagaataattaccgctgcacaggcatgcagattaacaggattttctgaaaaatttttactcatccagcatcttcagcaatgcatcccttggttctgtataatacaatacaaccaatctggcagcgagttcatcagacatttcgttcatctgttttctgcaggaaaccgggagaactattgctaaagcccctttttctgctgcaagttcagccatatcaagtgcattgtaaaccggctcaagagttccaccaacactcattcctccagcaataacatatcctccttttgtgcttttattaagagcagcagaacaaagggcgattaatataggaacagacaatgaagatcctccactgaccggggtcattgcccggacctgaactgagaattcaacagaagtaggatcatgatccccgacaagagattttgcacgagtatagagaacttgttcagcagatcttaaactttcccgaagtccagcagcagcttttacatttatcagccggatagaagatccgggagtaacagtaatctcgagtttataaagtccgttcccttcatttccttctccaggacctaaagcccagacttggccgggagggagaggctcaggtgaaattgtattctcgcgatggagttctggtgttgatacatattgctcaatcccttctattccgagccggtaactaaacatagtatttcggaattctgcggaaccgatccgtttttgttgttcctttactcttcttctacattcaagagcaaggcggacagcccattcaagatcttcatccgaaatatccgagtcatgagcaggatatagaagttttagtaatccatcaagggtttttaagacacctgtccggtctcttcctgatagagcatccccaaatgatacccgatccattatcttcggtaagcgggaatcatttctgagttgtctaaagcattcagacaggaaatcagatacaagaccgaaatgagtggtaagttgtgtcgggtgatatttcgggaaatcccatcctggtatgtaactgtgaatccggtccatgaaagcagtatcatctctcatctccggagggagggggccaaaaagatgaccgatccgttgttgatgttcaacatcgacatcgaaatttcccaccattacaagccccccctcagcccggatattttctcttccacggctgaattgaccggaggccatatagcctttcatgatattgaccccctctttcgtgtcaaattttattcccgctacttcatcaaaacaaacaagatcatattgacagacaagtcctctctggcccgttgcattattgacgaacatctttgcaacggttgcttttcctccactaacgagatgtgaatatggactgatttcctggtagatgtaacttttacccgttcctcttggacctagttcaacacaattgtagttcttttctacataggggatcatccggaggaaaataacatcctgtgctctttttgagagggtttctggttcaagtccaatacttctgataagaaatgaacgccagtcttcggtgctcatctgcttccgaccttcagcaagatcggaaaggacatttcttttcgagagttgaatcggttttaagtttgtgatagagaatggtcggccccctttcccctctattccgcttccatattcgatctcgacttcagcataaaaccccccggtgagcatccgttcattatcatagaccatttccgcagggatgtatacatcatcaaggatcaaagagggaagactagcttcaaaagtatcagttttcgtatccagccgtgcggtaacgagatctattattttgactgatcctttctccctggcacgggctttaaataactcctgttcacctgcccgaactatccgttcctgaagttgtctttgaacgatctcaagtccttctttgatctcttcgtcatcagttgttgcgcaatatcgtccgataaggaattcagctacataggtagggaccggataacttcctctgaattgctgtgccagatctttccggacaacgtatccatcaaatatcttggttacttgttcgtccaggttatctaattcggccattttacttacatccctccaatagtggtctcttcctgagtgatgatctttccagtttgatcagtaatcaccaaccaggccttttttccttcgtgtgtgtcatcccagattgcgatggagattacgccatcaatcggaatttttatttggtctagtgaatttccatccttatcttttaggaacgttgaggtagcatctccgggctgttcccgaatatctatgatatatccaggaccagttgtggcggtaattttacaacgcattcccttccattttatctcatcgatgaccacaccagtcttaagactcctcccttttataatagtaatttctggaattaccatctcctgaggagacaagccaccatgatcgaagaccgtattctcctcaaagcaggcacccttgggggcacatgcaatattcttcgatctgtcccagaaccatgggagaaccggatatgatacctgggcgttatcacgtaacagagcacaacgtcccttttttatctctgtatttcccacgggaagttctgctttttccatgccacccgggagatagataaagccatggtcagtgacaatattgatcttttcccatccagtttggattaattcaataattcgtgcttctattctggacaattcccgatcaacagtatgagcaagagtcaatcccttatcatgtccttcatgatcgatattgccaaattctgtccatcctcctcctgttgggtcgcccaattcatcatttttaatgacctggtatccttgttctttgaggagtgaacggagtgattcgatacgtgcaaaagctcctgaacctgtctttggagtgagttcatctcctgcatatagtttggaagcgacgggcattaccgccggtttagccgtctctgtaatgcttgggatgactgataattgaggggtaagggtagtctgatatccagcagcagacaggagggattgtaaccgatgaccgaggtccatccgtagaccatcaatgaaaaagtagagaactccagcttgtgcagggatttcttttttcttctgctctggaggggcttgtatccaggttttttgaaatgcgtcaatagttgtgttcagccagggtttgtatacatgagcaatgactttttgtaagagggcgagatgcgatgaggtgtgaaccgatgctatcgcggagaggactgcgtcatcaatcttccatgtttcatcagcatatcgttcgatttgtgctttcaaatctccgccagtctttatctgtcttgaattttctaccagaatcgacaggtacttgagagaatgggcgagatctgccttcccgatccgtgcccatacccaatctcttcgctttttgtgtttttcttccatttcaaggatgagatcttgtgcctgtgcgagtggcaaagagaggagcgattccaattctttcaagagctcagtctcttccttctcatttatctgtggccaggattcctgatacggggtgaaagcaggaacttttattgtagaaagaatagcgggaatgtttggatatctctctggattttcagtaaatctatcccatatctcattccatttcccttcctgggtcgcaagcttggttgccccggcgagtgatccgtctctttccggattgaggttatattcttttatagatattccacagaatggcttccattgccctgattctttcatctgcttttctgtttcaacgggatcatgaatccaggtaagtatctgttttcgtgggtctggtaattggatttgatgcagatatgtcgcatgtaatggagcgtgatgtgataacctttcgattggctcgtcaagaagaagtccaatactcgtccgtagtgcttcttttgtttctccatcctgtttgatggcaattccaggtcctggatctgatgattgtagaaatgtaacaagggtccagtctttttttgttttcgatgtccatgatacgcttcggtgatatagccccatcaagggttttagttctcctgggacagttgtggggtcacgtagttcttcccgactataaccggggagatagagaatgggtatgttccgactgttatcttcatggtgcataacagaagttctgatgtaaattgccgggccggtcagtgtctctttattataagacccatacgtgtagatggtaaatctcttcttcaggcgatcaatgactggttgccattctccggttttatcaaaccagaatacagagagaggagcaactacgtctttttgcgcatattctcgtgagactttttgaagagaagcacaaataacctcatcaagtttttttgtcatatcatggttctcctaaaagtggagggagctgttctaacgttgtcaaccaggaattaaaatgaggacatgttgaacgaatatgatccagtggaatttttttgattattaaaatattatggggatttttctggtacgatgggtaaacatgatgaagtcttttagatggagccgtatttggattatcattaattttctcgggttcgccggcgattctaataatttcctgcagtttttctttttgtgatggactatttatgccaattacattgtcgattgcataaatatcagaaaataggagggtttcatattcatagagttgaatatgaggaataaaccgtcggttggatatatcttcactgattgatgcttctaatacgatcactttctctttaccactcattgaatcagttatcatttgatttcctggcgtatcatgagggagaccatagagatcgaacatagtagtgacataacaatccttacggctgagtccatttctaatatttttttgtatttgagtataggttccaacaccgcccctgaaggtctttgagtggattgatgttgttataatttgtacaattccctgaatgccaaatgaatagagatgaggaatgatgatctcatgaataaattgtctttcagtttgaccttcgactataaagtggagatgaatactcatgaattcaccgtaggatgactgaaggatcgccacccaataagccactttgccataattctgcaggactataatcctccagccattctttgagggcttcctgatccggagttctgatggtagaatacccgtgttttctttcaataattcggatttcatcaagagtgaactggtttaagagtaatggggactgagttgtgataagaacctgattatgtgcagaagcacttttcataagtccagcgaggatatcaattgcaaccgggtgcaatcctaattcaggttcatcaattattattattgaaggtcgcaactctaccggttgcatgagaagggttacgagtgaagtaaaccgaaggagaccatctgacatctgatgtccctggaagatagtatcacttccttcttcctgccatgcaaggcgaatcatctcctggttctctgctgtgggacgtagtataaatgtatgaaagaacggggctgcgagccggacggtctcttgaattaactcaaagtgttgaggatactggttcattataaggtacaggtatgctgcaagattggaggcatcaggtttcagggagaaattatcagatattggcccaataagacgtgcaccagaggtgtcactggtgtcatgaaaatgatacacagaggtgtctgaaaggaatttttttatcttttttccgtcaaggagatcataattcaacctgattaggatgctttcccggtacccgggtggatttttcgcatgtgagacttccctgactcctccaggaaaggtttgaggtctttttatatcctcctgaataaacacgaggttatcatcactcgaaggctcacaggcagcatggtacacaaactcttcaaaggtaagagtaaattcaatttttttagtggtatcaggaccattatagagaagactatgtgcaccaccagccttggctattgcatatgaaaaccgaccttctgctatcctatgtagaaaataaaaagcggagagaaggtttgattttcctgatccatttgcaccgatacataccgtgaggtggttaaggggaagatcaacatattccagtgatttaaatcccttgatgcagatattttttaatttcatccgtgttcccctgcctcttctctcgccttcagcttctctgccagtgtgaagtgcagatcattgagccgatccgtggtcccggaacagttcggcaccggatcttttccccggtccttgttccagttgatcttcggctgactccggagcactccagcagtaacaaacggcctgatattcatccgaactccatcgtttaaatcaggttcccatccaatcggctgctcatggagcggtttccatctcacatagatatcatagggagactctccgttcaggatgaggatgagttttttcttgaggtcttcagcagccttgagccggagttccgctccggtcttttcagctgcaacctcttccctctgctgggcaatccaggcaccgaggtatgaatagatgagtttttctaatgctttccggtcaaggagatggtaattgacgaggaccgagaatccgtcttttctcccgtcccagatctgccagatgaatggtcgctggtggaaaagtttacagtgagcagtaaagaattcatcccggagatagagttccaggtctccctttaccgctccctcttttgtggtatatccggatttgatgaggagttcctgctccttctgaattgaccagtctggaaatgctgcagcaagcatagccctgacatattcgaccagttttgtttctcctttcaccgggggaagacagagaatgccgtcgtcgtcaacgtatggctgaagttcctttgctttttcgacccattcccgttgttcatcagagagttccatctccgggtctagttctgccggccactggtatttgagaagttttgcgacggctacctgaatcggatcatcggagttggccgggtggccgtgaaagatccactgggtagggtcggaggagtagggttttggcaagccgttggggtatttctcggcggctactttggtccagtattcgagatcgaaagggactttcacaagggttgcatttgtgacgttgagtttttgatcgatttttcgaaccgcatcgtgatattcagaagatgaacagaaacaccagattgcagttagatgatctggattatagggaataaatgtggcagtattgttatcataatgtggcccacaatgaatagtcactggaagattgttcatttgagatatacgaacacctattttatcccatgcttgccaaccttgtttccatccaccacttgcgtattgtttttcagctaatattctttgatattcagctagttggccttctccattttcccaaagtaaaatttgactattccctgaataaagagaggttttttctactgtagatccaaaatagacccactctttacctttttcattttgctcccaaaaattttgaataaagcgtaatccatccccagttctctgacccatatatgcaaatccgaatttctctaataatattccttgaatattatcaaaagatattcttgcatcgggattatcaatctggcttctttgagagatttttgtaatttttcctgttattaatttttgctctttttccattggattatttaatttagaaacatctaatccttctatataatggttttttttatgaaatttactaattattagtaattgaatattaaaatcccacattggagtatgaaaccccttaggcccaagacgtgcaatcatattccaaaccgaattattcaacaaatttatccgcaatttggaatatgtagaaagaaataaccaattttgtggaattacaatggttgttgtccctccctttttacaaaattccaaacctttctctaaaaatactgttgctagatcgtttttagagagtggataataatttgcacagaaatccttaatgccttcatgctgtttcagccgtactaaatatggcacattcgtcgcaatcagatggtatctccctgccagcattcctgcagcccgtgccaatccatgagctacaactccgattccctctcgttcctcatccctctttgtcgctaggactttatcgagcatcggagcaatctgatcccaagtaatcggaatgattttcccttctccaaaccgtcgcatcgggtcaattaaactcccaaggaccggagcctgggcaaactcatcatacaggagatccagggcaaaagcaagatcctgattatcaccggcaagagccacccactcctctttcttcgacgttatcgcaagacctgaacaggcaaccggcatatccgggagcagatggtatcccccggcatccggataggtccaggcagccagagcaagagcaaatgccgcaatctcgacacaccgctcatcaatctcaagtccatggaggttttctgatagaacggcatctaccgcttttcctgctgataacccttccatctccatccgcatcgggaccagcatgagaagcgtagccacgagaaaatgccctgaaccacaacagggatcaagcatcttgagttcagaaagctggtcaggccactcggagaatgtcccggaagcaggagtccagactccattttcatcctgtacaaaccggagataggtcaggggaacaccggggagagacgccttttgtctcaattcctcttcagaagtggcagtcttgagatcctcttctttcaacctcttccctgcccaccaggctccaagtgaattatcaaggagaaaatggaccatgtatggttcagtaaagagctgggtttgggaaggcaattccgcagctcctatcttgacacctgacttattcacctcatctttcttcttcgtctgccagaactggtatgtccacccgagggcatctgaagttctgaacgtatctcccggaatctgtgcaaggatatcacgaagagcattcctatcctccggggcataggttatcttcaggagcggatcatcctgcttgaatatcccggggagcatgtccgaagcataccgggcagcaagttcccaggggtcaacctgctcatcatgggcgagttcaaccagatcttcaaaactaaccgatacctgatgttcaggatggatgaggagatcattctcgataagaaaccgggcaaacagcatccggtgccattgttcatacgcaaccgaccggataaattcctcttccgtaccaagccgacgcaataccacccgtacccggcgacgaagttcagcctgctcatcactcaggtgttctggtttcttctcatccgataccccaagtgagataagagctttccgtgctccttcctccgagatatcacgggctttttgaactgctttatctagagcgttccggtcagattttgaaagggtggtcactgtatcaaaacctcctgtttctgatgtgaaagaacgatattgcgaatcataaaaaactcattccctggcaaggctgatgatagcaggaggaacaacaatatctccacaaatctccttgattatggtgaggaggtttaactggtgaagatacaacaatggggttgtattacagatgatcaatcccgagtatttcagcttcacgagaaaactcctcttcggtacgtgtcagaacggggaactggaactcttttaatttagagataaaaagaacacgagagatccctgccatttttgctgcagctcctgaagagagacgccccatctcatacaatttcacagcagcaagtaaccgtatctcatccccaatacaggatggatgagtatttattgccacaaacatatcatcaggtatagtaattcgtatctcggtcatggtaattcctctattgttcgttcccctccgctatagagagcaaaattcaacgtttctcccagagttcccacatgatcattggataagtacctcctgcttctgctgtaataactcattcacccgctttctgatatcatcaatatatatttccagctcttcttcatttgtaatttttactcctcgtttcagagaaactgaagtcagaaccttcttatgttttgcagcatacaaatgagcagcatctgaaacaattggcccccgtgacaaattaatgagttctaacgctttctgataatctgaaagaggataccgcttcagggcgtggattatctcctcatccgtcccaagaggcatctggggaatctccctgatatgatgagaagaaagaatcttctcctgctcatgagactcaagctcatgccagtttggatctccctccagtgatgagatgagattctgatatgcctctgacacctggctgataccatgagatatctcttcccgtaatcgttcctgaaccttgaaaagaaggtcggtgaccggatcaggatcagagagaagacttctgtgctccttgatggctgcagcctcatgaataatcacatccaggccagaaagtccctcaccatggtcaagtagtttacatagccgtgaccactcctgctgacggacagcaattacatcaacaatacttttccatttctcaatatctgaaataattatatccttctgtgctgcaatccgcttgagaagagacacaccagagagcccatccatctccgccagatatgaaggaatcataacttctggtaacggtggatctcctccggtcttttccagaagctctctgagtttttcaatacaaagagaagcatcttccccttcagaccccgccttggcctgaattccaaccttttgatacactgctttggctttcagtttttcctctgcagtcgggggagattcactctcacacgtaaagaaactcttctcaagagtccgacgattatcaaggtcacttaaagagacggttttatgactatcattagtagcatggagatgtccggaggcacacagagcaataatcgccccttcaattgcatccttgggccatccaaaaggagcatcctcatagtattttacgatttcagaacccttctttgaatttgcattcaggaaccgtaaaatctctttacagacattatgttcttcagtattccctgaatgaccgataactgaaagcggatttgcatgacccgatttgattcttgtaaaaacatccgcccaacgaggattatctgcatccttgaaccggtaaaatttcttttctgatgcgattttcaccgcattcaagagaacctcttttggtgatccaccctctttcttatccccgccaccaagatacacaaccgcctggctgatgatatcatccagataggcttgcacttttgtatcatgagcaaccttcttcgtttcaatattcttcttcgcctgaataccttcattcgtattcgggacaccaatcgaatccatagtctgctgggctgcaatactccctgcaatatgatcgatcagatcctgatgatggtgctttggcagaaatatctgaattagcggactctccgggccttcttcaagtgaggtttttcgaacctcctcttccgaactcccccatccatttctcacccataccgggatctttttactcaccgggggcttatcttcggtaaaaatcctggcatcaatctccctgacggtcttcgtatcgccatccttatacgatatctgtttcagaagggcttgcacagatttcatcaatgcctgatcacggtcaaacgatatccgattgatatcatccttccatgcattgagatttttccgatactcctggtcccatctcttcccttccctggtctgaatcctgagtgtcccatctcctgcatcgctgataataccacgatctttcaggtcatcaataagaagaggaacctcacgacggagatcaactccttcatactcaagacctgacaagagcagatcggtaatggtctccggagtggcacgaacccctaatgatgtatctacttgttgaataaggaaaagaagagcacaaatacgtgatttaagttgccctgaagaagacgaatcatcctccccccgaatcatttcatctgtttcctgggggagaatcccattatttataagatatggccgctgttggctgtagatataatcaaccggaataacatatccgagaggagactcagcataggtcttaattcccgaaaaggtaaggcgcaactggtttcgaagctgggttgacagccctccccggtcaatagaccgtaatatatggtcccaaagccgttttctggaaggtaagaggggatagtctggaacgagggattcattatcatcctgactatgagcaatcttcgaaccttcaatctgacgggtaatttcaccgtgaacactctctaaaagagcggataattttggtttctcactctctttctttcgaaggatagtctgccgaagaacagtatcaacatccttactctccaggggaacataaagagagaattttcccattagtttctgtaagtatgggtttgcatgaagtgcctcctgaccggtcgcaacaaggagacaccgactctcaaacttactggtcaatgcctcaactatctcctggaagagaacaagttttgtactatcctgctctaccgcgagatattgctggacttcatcaagcacgataagaacaagtcccggttttttcttattttgaatttttgtttttaatatctcatcaattaaactaaccatcaggtcagttgtcatattcgtctcttcagggaattgacgatcaagcctggtaaacaggtcctgaggagtggctccaagatcaggaagatatttgagtgcaacctgggcaaatgccggggagatgagacaatattgaagatcgtcttcctttcccatcgatttcaggtccgagcgaatagtatcaaggatgccttgctgtgcaagccatagatgaattcgggcaagctggagatcatgatccggataacctgcagcccgtaaaattacttgtaacactgcctctctgggatcatgtgaatcccctccggaaagtgtcccggcagcagaccatataccgcctgctcttctggtttcagtatcaagtcgctttaatgagtcctgaatatcatcaggtagacgggcaagagtccttgccgtagcgccatcagagaatgtaatgtcagcccaaaggaagtcaagaatgcgaacgaggtgtgattttccagacccaaaaaatccactgacccagaccgctggttgctttggttgatctaaatgatcaagaaacgaatctaaaatctttttaagaccagtataatatgatccctcacaaacaaaatgctgaagttcccaccgtgcaacctcccactcctgctctgttgtaatgggggcaaccttggtatacccatcattgggaatttcataggctgtcggatcattctgaaaaacatccttatttaatatcatatctctcttactcgtcttcatcctttacttcaattggaaatgccttataattccacccatcatgatcattcataaactggtagcaatacccccgatgactccctgggaaaaaaactaataatctgccaggaataggaagtttcttcactatctcctcaatcaatttactcaaccgaattatcccaaaaagtgcccccgtccctgaaatagcgattatctttgaattgtcgtctttatcccactgatgtgataaccgttcgatgatgaattgaaggaacattttttctgcagattttagacgtgtcggatttttgaaaaattcttccctgtaggggtggacagtacaccattcatcaaaaaatgtgaacatatcaataagaagccagctatggcctgctctttcagttgccaggccaaattcatctatccttctcagtaaccgacgttcatctgaaggatcatagacacaaaaccacaccttctcttcaggtgcagctcggggatcccagggaattgaaacctgcttaccaaagacgtctagtaacttttcaatattagtcatactccccccagagaacgaatcaagtctgaaatggtgatttcaatcacccctcccgctgatttatatgagataagccccatcacagaagcggaatggaacagttcatcccgttcggtatcactcaaatccagaatacttataaaaggagatctcataagcataactcctccgaatccgattaatgttcctaaataaagagcaaacgtgaatgaagccggaccagatgtggatttagtacgattttttttcccttttccaatgagatggcctgattgggtccaggaagaaagaaggttctctgccatcgatttgagagttttatcagtaaaggagccatccagattctgggttaaagtttgaatcaaatcatcctttcttgcttgtgtcccacaatcgagagataatatataatccgctgaaatcctgagtgacttatcacgagccaatgcgtagagtagtgttaatgtcgggtgttctttctcatagtgagtaaaaaggtatcgaaagacccggtacagcgggatggaatcatccagtccatacattcgtttcaggaatgaaaaggttttatttctgccggaaatactctttttatttaaaatattttcattaatgattgcatcttttatggtatcgaaaggagcatctggtgaaatattttgaaaaagcaactccatctcctggagcatgatagtacgagaagaatgtgaaccgattgattcacaaaagccgtattgtattggatagttaattattgttgaaaaagaccacacaacgagaatatttcatttatttaaatatattattatctatatgtattgagtggtttaaaacatgtaattcatgtgagaaatgtccgaatttagattatcaacaacaatttcaaaattcggtttgagataaataaaaatcgttttatttttcaactcttcagaaaggatattagccttaattccgattctgtaagatttttaaacccagacctccaggccggatagtgactgggatttttgataattactgatcaaaaggtcgagagaacatcaaaaaggaagatattaacttacattagaaagcggtttatttacaaatatggttttgactcagatttgcttgttctaccaaaagatgacggtccatctgccagtaaggatatagggagaatatcgtattatgccattcaagatgggatacctgtgaaatgagatatatgcaagagaataagcaggaattaaaaaaccttcagttctatctacaaacattctaaaattttttaactcttctttgtcggaataaaaaggataattacattgtaactccaaatgacctcaaaaattcaattttcccccattcatttcaattcagtctatccctctaagaaaaacaatacgtgagtatagatccttttgtggaggtatgatttcgcagaataaacccaccactcacgattcaccctaaaacatccccaaaaacccaaaaaaaattaatttatcccatactcctccgctgaatctcctcttctacccggtcccattcacaaagacactccccgatatcacgaaccagaagctgagctcccctgtacaccacttcaggcctcgaatcttcaggggacatcccacagaacatctcctcaaacgagtagagaatatctaaaatctccgtcttaatctcaaacagatcctcaatcagcgaagaaatatcatcactatcctccggcggggaaagccatgcagcctcagcccgataaaatccggacggaagatcagaacaggacatcaggacctctccatcagatcggagatcggatctgaaacctgcacattcccggttttatccacgatcaccaacggaaacaccctctttgaccttcgaacatacgacacccacaacccggcggtcccgataccgctcatcaccgaaacaagacaggacacaccggcaagaatcaattcaaatcccatattcatcaccaaacaccacctgctcggaaccattcatcgccccggcaacatctgacccgaacgcaactgaccgattcccgtcatcagaatacgccctggtaagcagaataccgctcccattcaccacgtacctggcaattgtctcatcatcaagcacccggctggaaacatactctcccctggaaaagagaccagataacctgacctcatccacacgtgccttcaccccgttatcctctccaaacagacactctgaatcctcatccgacccgttcaccacctgacctgaatactcatcaatccccatcggccctgctgattgaccccgtgtagacaccacaaccccgtcatgaatgaccagcgaccgcataagagatgccaggtcggttgtgaacagatgcgaagcataggactgaccctgaccaagcaccgatgacgatacccatgctgctccatcacacacaatcgatgatgtcaccgaatcggcatgacaggcaccaaaccccaggatcagcaccacaagaccgggaatgagcaaaacccggaccatctcatctcccaaaaaaagggagggattatgcaagggcaccaatggtatctgcccatgcctcaacggtgttcagaatactatcagactcataactggacacactgattttgtcccgtttgaaggtcacgttaaagagctctccattcgcagcatgacatttcagcacaacggtaaacccgtcttcagaactgtcgtgagatgaaacaccccccattgcagtacttatcgcgttattcgcgagaatggttgcaatattgctgtcaaacccagctgcccccggacatctgaccgaaactctcccaacctgcttcccatcatcattctcatagataaccgtcccggtatagtactcagaactcttctgaaccgccggaaaagtctcccctccggatacatacggcgtacaaccccacggattgtcagcaagaatattcccgatgatcgtgttcattgcatccttactggcaaacggagttgtaagaatccgttctgcactcttcaccaccgattttgatacaaaatctgccatgttcgaactacccctgccgtgtgcacaccggcctcttatgatagaaaccggactatatatatgaattcattccttttttgaatctgacagaaatttgcgttcaatttttaaaatatcaaatgagatgaacacgttgatgtaccctcatacctgacagcccggaacaccggagtagtaccctctcctccggacaaaatcctgcagatcagaaggatgggagtcacatactcctcaccatcgatacacagtccacacccccatctgcctggtgatctgaacaggtatcctctcatcaccctttcctcacctatccttgcatataccggacagaatccaaacccgaaaaacatcatcatggcttgcttcacatctattacaaattcccctgcgtcatggagaataaccacaagatgaccatcattgatagatatccgtccacaatgaaaccagctggtttcagtccgtttatgactggtattcatgagagcatagcacaatcctgctgccttagtctcacggggacatacggaaagatatgcaggtatacagccggctaatgagcagaaccggcgacgtctcacagatattggattcttcagacccttatacacctgccagacaaggaacgggcacctgtccatgacacattgccaggtaaccggccggctcataacacacctctctccttattgagcctggatagttcacgggaataacaggactcacatagaccggtctgtgcagatgaatcgtgccatgcaactgcaaacgtgttgcacacctgacaccggccaaggtcccgatctacccgtttcatcatatgcagatcaagcgttggtagcatcaccaaacgtgctacatgcctgctcgctgcccgggaataacactcctcacagagcatgaccggctctttctgattcttcagatctgatttcgtgcaggaatacaccgtatgagccctgccacagactgcacacctgacttttgacggccagcccgatatacgggtaaagtcagagggacggatctgtgaaatcggtattgaagcaggattactgcaggatgcggaaaagatccgctccctatctgcctgggaaagttcattttcaccggcattcagaagtttttgagtgttgtgttctgcagaggcggaaccacacaccggtggacgaggttccagatgctcatctaatccgttttgtgtgagtgtatgttctgcttcacataagggagtactactatgtacatatgtatatgtactattctgagtaatatccgcggtttttgattgtgaagcacttgcttcactcgtgcagcaatcatccttatttttccgcactgcttcactgactgatttctccggaccattctgagccatgtgagtcgtttgaccctctgcacactcgaagatctccacaacatcagagcaaccagagagagcaccacatttagatggatcatactcatctccatcatcagaatcagaagaggcatggggatcaaaagagtcaatgggatcatccggatcgataggaagatctgaatcagaatcacttgattcatcaccgtcatcaggatcacgccctgaacacccggactcatcccggagactgaccgctccaccctttacccatgctgcatacagggaggcatcccaggcatagaccttcgttctccgctgaatcgtccgaccatcttcaccggtcgtcaccgcccgctcatacaccgatatagcaggacacttctcaagaaggcctgaatacgtatttccacgggaattatacccgttgaggagtttgtagatcgatgaacttgcccacccggtaatcctctgcagctcaggaaccgtcatctcaacaagccccattttctcaatagaattgatgagggtagcctccctcctcgtcagtttcgtggactggccaccggtctcaccattgagagcatcatacagccgtaccgcttcagaaaaatcatcaatggtcgcagagatacaaaccatcccatcccggatcgtccgctcccgttgaaactgcatgaggattgcatgagtctttatcagatcaagcaacatatccgggtttctccggttcgacgcagactggaactgaatacgctctgcataggggatcagaacaaaggcaggctcaagttttcgccacatctccctgacaaccagcacatcctcccggtcgtctcctctggtatcaggaaggtgagcagcttcagccagcatccgggataatacccgtttatcctgctcctcactatcatcaatccaggcagttagcatcctgttaaaaacctggtcatccccggcaccttccaccttggctatccaccaaacacatcgctccgggattgtacaggtaacagcattccggtctttacttaccgtacggtaggtaaacggacgctgaaatgatgtagttacgccctttaaaatctcctgcatctgatctgaaagtgttacatcgtcaagggcaatgaccgtcccaggctgaagatccttgatgtaaaagagtgccttatcactcatccggccactgagcctgacttccggcgggacaagattcatcatggtatcaatagcatgagacttgcccttccctgactctccggttatcgagacatgaagtcccttggagttgatcaccgaccgggacgcaagagacatgatgaggcactcggcaacgacccggtctccttcatggtcatgggagaaggtgtcaagcatgtacgggatggggtctgccgtggtgagaatccgttctgctttctcctctattccaggatcagatagtgatgccggaactctcccttcatagaccgccttatcccgaatccgatctcctcggagttttttcagtcggtcttctatatcagaggtcccgtcatacttccgtttcaggtcctgccaccgctgggttcctcctccgcatgaatcatgatgacatccggcaaagatggcacctgaactgaactggatggcatacgctccgtcctgatgggcgtcagagaacggacactggtccaggatgtagagtgtcccgtcagcgtagggttttgccacatagccaaggtcatgacttttaagccaggaggcaaggtctgtcacgggttcttcttttccggttttggtcatcttctccggttcttttggaaagattttgccaagtcggtgaaggtcagaatcaggaaccagtgtaagccgttcaggccctgcaaaaagacaggcttttcgatgaggacgctcggttgtattatcacctttccgtgatgtagtgccatagagtttccatatccgggctgcgttaaagttggcacaatcaactgtgcagacttcatcagagaagaggagatgcagggtatgcaggcaggatttgataagttcccggctgtcatcatcatttggcaggtctatccggtacaagagatgggccccgtttcctgaatctgctcggagaggagcgggccagccaagagaggtgagatatgcagcaatttcatccgcctttctgaatgctgctgcatgttcctcgtcagaggaggagacaccggatggacgcttaggatcgatgtctatcggaagccagactctgcgggtgatatcgtgatctgcggttgtagcatccttttttgttagacgcatgattatccggttctcccgccgtgcaaggagtgccgggttgatttcgtttaaggtgatgtatatcccttttatctgcggatttgagtctaggatcttcaccgcttgtgcaagttttgccggattgttgtagtatcctgatccgattccatcctgggtgataatcctgacctctacaacctgatcctttctggtaagtgttaaaagggatgagaggatggggtctgcttcggtcatatgagacccccggataaggcacgaaatcctccggccatgacatgataccgtttccagtccagacctcctccaatccagagttcaaccctgcctgggcagaggatactgctgacaaaggagcgaagccggtcaagatgggcagtatatttcttctttggtttcatgccgcgaacggagaatgccctgacgaaaagaatgtcctcccgtcctttccaggcaataaaatcaaccgggtagtgacgattggtaagatgcatcgtgcaatacccatgagcctccagaaatgacctggctgcatgaggagcggttcgcatggtctggtattgaggtataccggtcatgcaacccacccagaccgctgccttgaacctgaagaaacgtaggtaggtttttctaatgccaaaataatgtatgaatagtccccttctgtgatccgccgccaagctaggtcatcggttggggactgggcattcttcttctcttctcgtgtttgtcctgggttgtatctcaccggttcttcttcggtgtggatatcccggtgtatacgcacggatgtttcgttcatgctgttacctctcctgccggaatggaaagaccacaggggttttaacaggggtcagtcctcttccggaagggagaagagcatgcatccggcatggattaaaatttagcgatttatgatccataaataggatatattatgcatagaaatcagatcaaccatgagggtgcggataggaaagggtccttgttgagagatatttatcgttcatacatctgagagagggcagaggggaagtcctccgttcatctggtgcagctactgctagtatttcagaaagggtacgtatcattcatcgaaggatgaacagaaagggggttcataggtgaacccatgacaacgatacggtattattttaccaaagcagagtatcactcatgcacctggacaggactgctcatcatatagcataccggattattattatcctcgggatagtcgcccttttaggagatatcatatatgagggtgccaggagtatcagtggcccttacctgctgacccttggggcatctgcggtccttgttgggacgataaccggcgccggtgagtttcttggatatgcagtccggctcatatccggcagagttgcagactctaccaggatgtactgggctttgaccgctctcgggtatgggatgctgatcacggtgccacttcttgccttcaccggttcatgggagatggcagcagtcctcttcatacttgagcgaattggaaaaggaatccgttccccgccaaaagataccatcctctcccatgcaacagcacccatcggtcggggtatgggatttggcattcatgaactcctggaccagataggagctgttgcaggcccagtcattcttgcagttgctcttgccggaaccgggacctataaggagggatttcttctcctcttcattccattcatcatcctcatcggacttgtcctggttgcatggagactcctccctgaccccgtgtcatttgagaaaggtcatatcgctctctacagtgaggctactgggatcggtcgggaattcatcatgttctcagtcttcaccctcctctgcacagccgggtttctctccttcccgctcatatcctttcatgcattacagaccggtctcatggttgcatatgaaatacctcttctctatgccggtgctatgttggtggatgcagctattgctcccattgccggaagactctatgatacaaaagggattatcctcctcctcccaattcccctcatcggtatcatcctcccgttcctgggatttggtatgggcagggaactcatcttcctctcagcaatcctctttggtatatcaatgggaatccaggagactgttcttcgtgctgctattgcagaccggattcatatctcaaagcggggaaccgcctatggcatattcaataccatctatggagcagggttttttatcggtggaatacttgtcggctggatgtatgagaattacacggcatttgcaccggctgtcccggcaatggtgtcacttgccgcctgcatcgtctttatcagggtatggcgatcttcagaccaccaggaatcgtaaaattctttcataccttttctggcattggtaaaatcaaacccttaccttttattatgaaattactccaataggtacatacagcaggtcctcccttcaagaaatcctgccggtgatgagatccaccgtaaaccgcccgctgctaatgacttctacccggaagacgtatgttatccgaaggtgaaaaggaaaaaacgattcgctatatctctgatcgtcgatgtcaaagtggcggatattgtttttatcagctcgatgagccaaatctgtctgatacctggtatgccctgggctgcttagaggttctgcaagcggctttttcagacaatctgacacaggagtatctatcccgctttgttaatcaaacccggggattatcagggttataccggctgtggtatcttttctggtcattccggtatctaaaaagaacaattccagaacaacttattgctcacctgttagcctgtcctgtgccgacgatattccactccggaacgattgaatctgcatcattatttgagccactctactgttatgttattctctgtgaggaggcaggcatacagcattccgaatcagaaaggaaaaaaattcaggaagaagtgttaaggtggcagcacccatccggagggtttggtcgtgataaggcaacccttattgagacaaggcatgcagtcgcgattctgcagggattccatatagagacggatgcagagaggatctattcatttcttaccaggtgtatcgacgaacaatcaggattcgtaaatgttccctcctctcatcctggttatcttgaacatctggatgccggaatcgcccttgccaaattactaagccgtccggttccaaaccgttaccaatgcctcctgtatctcgataaatgtagaaatactaatggcggatatgcacggtccggatttggagggaattcaacacttgaatatacctggtatgcaatccggagtctgtgtgggttacataacaaaaccggctggaactggtaacatggcttgtttcaaatttttaattaaacctattgtgataaataaatgacaccatattattgttcatcatgctggcatgaaatcgaaggagaagtatcattctgtccgaattgtaaaggtactaacctttgttcagaagagaggtttgcggacactctcataacctgcctttctcacccggtccgggagtaccggctcatcgctgttgagtcactcggaaatatccgatatgaaccgggcagccatatcttacctctatcgttcagtcagaacagggtatggagatgagagaggcagcagttgaatcaataaaaaggatacatatgtaccagcaagggattgatcaggagaaccaagatacacacttccataaaagtcagatagtacctttccgtgaatagggaagatgtcaatacacccattatacaaacatatatgtcatactggtgatggagttcaccaaaaccgccgttcgggctgataactcctacaggatgtatattattggcttcatggccatcattacagatgtggagtatactacatgcacaaagacggacacgataccggatccctgctagcacaggattatgaactcctgcaatcacttggtcctgattatacatcatacaaggaacaagtatccggtcttatctcgcgactggaaagcggacgatttcatcttgctatccttggtcagttcaaacgggggaagagcacatttttaaacgcccttcttggtgatgcagttctcccaagttcagtcatcccactgacagcagttccgactctgattacctataaccaggaaaaaaacgtcagagtaaagtatattaacgggaaagatgatggagtttttacatctgatgacacgaccctcatcaggaaatttgttgaggcctatgtatctgaagagtcaaatccaaagaacaaacttcaggtactccaggttgaactgacctggccggcagagatactggcaaaaggggtcgttcttatcgatacccccggtgtaggttcaacccataaacataacaccgaaatgacggtaaattttctctctcagtgtgatgctgcgctgtttctcgtttcatcagatccaccgatcaccgagatagaactggaattccttcaccagataacggatgccatccccaggatctttttcctcctgaataagatagattatctgaacgaggaagatatcgccgttgtcagtgaatttatccgaaaaatcctcattgaaaagggcagcatctccggggatgttcagatatacccggtgtccgcaaaacagggtcttactgctcgtatggagaaggatccggtcctctgggagagaagcgggctttccgaagtatctgatcatctggtttctttccttgctgaagagaagacatcagttctcgcaacggcaatcaggaagaaggcagcggtagttattcgggatgtgatgatgagaaaggctctcgaggtacgatccttagaacttccgatgagtgacctgcagcggcaactcgaactcttccgggcaaaagtagaggaaacacgtcttcgtcaggtcaggacaaaggacattcttgcaggggatcagacacggatcattacgtggcttgaagaagctgtggccaaactccggaaaaaagcagcgtcatatttcacggaaaaagcagtcgcaattctggaacagaacgggtataaaccggatgaggtccatgatgtgattgctgaagagattccggacttttttgagcatgaacttcggattatttcgcatacgaccgagcagaccgtaagtcttgtgttaaatgaacaccagcgtgatgtggacgaattaatccgttcgatcagaatggctgcctccagttattttgatatccctctgcatgagaccggagagaagaaagtctgggcccttgaacatgagccatactgggttgctcgaaagggatggcagaccatgatgggtatcctgactgaaggaattacgggaaaactgcttcccctttcaattcggaaaggaaagatcgtctcagaagtttcagataatataatgcagctcatcctgcataattcggaaaatatccggtgggccaccctgcagaatatcaatatgaccttcctccggttccatagtgaatttgattctgatatgaaccggattattgaagcaacagagggggcaatagagactgctatcagattcagaacagaacatgctgaaaagactgctgatcgtcttgctgaatgcaaaatggttctccagtatatagaagagcgggaacaactgtatcagagtgataattcatgacaaaatgtccgtgttgcggatctgatttatttgggtacgaaaagccctatgaccggttaaaccggggaaaggttatcggagttgcctgttgtccgtggtgtaaatggaccgggactggtgaacagtaccgcgatctggatgatgatgacgtgaaaattccatattgaacgaatacctcttattttttattttagaactcaggtgacggactggatatggagatggtggtgaaaatacggatggaatagatatctccaccagaattgttgcgataagagagacccataaccactaaaatttcatgaactcataacctcatgcatcaaaaaaattctatgaatagtacatacaggtatctctgtgaattgagatattttatcagaggatttcttatattgatgagatcatacatggaaaatgtatggatggtaattcgaaaaagaggacatcatcatctacgtcaaaaaaactcatataatcattttttcggtttacgattatgattaccatacggattatatcgaaaaaatgcatgattttttaatttaccggttattttttagtattcttgttattcccgcccgatattgaccggcagtattttcatatgacttttcaatcaaccctaatgtctgttcagtccaccggaccaaaattcgtttatatacctcaaaacttttcttcagttcttttttcatgagttcttttaattttgatctgatggtattttctagaaacgcccggcccaggaatgtagaatagaccggaagtgagaacgagatattgagagaaccgggatcatatcgtggcatatcatgaatctttgaccggagatcttcactatccctgataccaggtatggaaaggatggcagcactcttttccaggatgagatccagctgtgatgcaagttctataagtttgtcctgcaccggagtgttctcttggtgaacatatcccacgatatcatctctgataagagaatgcacctccccctgtgcatcagtaccattcatggattgaattacatgctctgtcatcatctcccataatggagaaagatcagagaagagattcctgctttgatggagggcataatttcgggtctcttctatatgagcagacccatttcggagtgctgtttcaatagacaagagttcctgttcatgttcgggagttaataattcaggatctttctcctcctctgacagtgcatgttgaaccgcctcccataacagaccgatctttcgctggagagaccgggttttcatatcccgtgcatctttcacgagcgggagaattgctaattcaaaccaggtatccaggagatggcggtgagatttccgggtactgaccagatgaaccggataatgaacatcacatcgcaccgttatctgtgaggagatatattcgcacagagaaagactctcttcatcagagagaagatctcctttacttaccagaatctgaacgggaattcctgcactctgaagtgaatacaccgtctgaatatcctctgcagtcaacgttgatccggcatcgatgagcacaataccaagatcacagctgggaaggtatgcacgggtaagtgcagctccgcttgtagcaagagacccaagaccgggggtgtctgcaaatcctaccccttccagaagtctgtgagcaggaagccgcgcaattatccgggtaacatgccgtgaattagaagggttgtgctgctcggttgcatataaaaagagatcttcaggagggcagacaataggatttttatcaacaaatgtgaccagaatttcccgtttgtcgctccagcggatatgaatagggagagcagtgaccggagttactccgacaggaagaagatcttctccaagaatcgcatttaatagggatgattttcctgaactgactctgccaaatacggcaatctcaaatacctgatcatcggcactgtcaagaatagaggatatctgaccacggaattccacaagcccataatctgatacccgctgctcaatggtgcgaagaagatccagatcatgggatgtactctccagttttgagagtcgctctttaatattctgtccaccggtcccggagaggaactgttcaacctgacgaataagaacccgaagctcacttaccgcccctgacaaacaggtctcgccctcagtggtcatcattccatacccccgcatcgcagagggacgcatttcatcgactgatatctgcatcgatgccagcctgacacgaacggccctggatgccggaatatccggagaggtctttgggatacctgcactatcaagaacccgggaaagcctgtttctcatatgggagatatagtcttcaatgcaggtcttctgggcaggagttatatcaggcacatactgtggaaatgaagtgtttgatgaaccttcatccattatccgttcaatctcatcaaggagatgatccaggtgctgacatccgattcgtatcctgtttgcatgacttggagagaaaatcccatttttttcaggttccggtctcttttcagacatatccatcaccctggacaatatccgatagtaccggatgaaaggagagtgtcagatcattctcatatgtctgtttccatacgtatgtcataacccctcaattcctggatgaaagtgtatttttgagcataagacggatctcctttaacggattacaaaatccctcagcaagcctgcctcctttcatatcacgggcgagtgcatcagcataaagctggtgaatgaggataagaagtctccagtcatcttgcatatcagggataaaagagaaaggatacaggcttaatctgaaccgctccagcagatcagctggagttctggattgaattaagttatcaaaaaatgacggtgatttctgccccatatcaatgataacgtcatacagcggggatggaactgaccggtatgaggaggtaagatcctcaataaaccacttcatggaccggatctcctcatggataatcctatagtgccggttatgatacagatgtaacatccgatcaacattccgattcatctcatatgcaggatcagacatatggccgggtattggcataatatatcctgaacgtgacaggtagtcaagatgtgcctgaatatttttcggacttttaaatcctatttcggatgcaatatcacttttgtacccaaagaatcagcactcgttggtattggcggatgtatcggatctgttgcccggtatcagatcaatgaatggattccgtctcttttagggacatttattgtcaatgttctggggtgcattgctatcgggtttctgatgtacgaatccatctactttggagcgttcagccggaactctcgtctcttccttggtgcaggattgatcggatcatttacgaccttttcagcctttgcaacccagacaatagaagcaggacttttttatggaataatctttatcgctgcaaacatactgtgcggacttatgggagtattcattggacgccagatcatacttcggggtaggagatcatggaacatctgatccttgtcgggattggaggagcggtcggggccatgcttcgctttgagctctcaaaactccgtccagtcaggagcattcctctgggaacggccctggttaatattatcggcagttctctctttggatgcgtcgttttttccaggtctcccggagatatcttttacctggtggatgtcggaattctgggagggtttaccaccttttcaaccttctcctttgagacgttcaggatgtttgaggaacaggattatcagactatggttctgaatatctcaataaatcttataggaagcctgattggagtacttttaagtttcattcttgtgacgctgattttaacaggaggataaatgttatcggatggcatgttattacgaatatatatcgcggaatcagcaaaaatcggaaaaaagccggcgtatcgacatcttgttgagatgttccagaagagaggatttcccgggtgtacggtattccggggtatggttggatatggacatgaacaggttattcacaccgttgatgtcctgaacttctcaatggaccttccggtggtcatcgatgtcgttgatacaaaggaacgggttatgagcatagttgatgaagtggaagaactggtcgaacacgggcttgtcatcacccatgatgtgaagatgggaagaaaacagaagtaaatcctggtaaacaggaagaggagtcatcagctggaaaaagcggttacaggtgaaccccatcaccctggtttacattatgcagaattgaatgcttgtcttcctgcgtatctggccttatctccaaggaactcgttaatacggaggagctgattatacttctcaacccgctctccacgacagggcgcaccggtcttgagctgaccacatccaagtgcaaccgtcagatctgcaatgaatgaatcacaggtctcaccactccggtgagagaccatcgttccccagccggctttttgagcaagacgaatggcatctatggtttcggttaccgtaccgatctggttgagctttataagaaccgcatttgcagtcttttctttcagaccgcggtgtattcgttcaggattggtaacaaagatgtcatctccgacgatctggatggtatttccaagacgttttgtcatgaatgcaaacccttcccagtcatcctcggcaagtccgtcttcaatagagatgatcgggtaggtccggatcatgtcttcataataatcagtcatttcttctgatgtgaggacctttttctcagtcttcagcgtgtattttccatccttataaaatccgcttgatgctggatcaaggaccagagcgatatcttttcctggtatataaccggcctcttctattgcgtggacgatgagcgacgcaggttcaagatttgacggcacaatcggagcaaatcctccttcatcaccgacaccggttgaaagtcctttctttttcagaactgatttcagggagtgatagacttcgcatccccaccgaaccgcttcgggatagtcaggagctccgaccggggctatcatgtactcctgaaagtctgatccctgccagttggcatgagcgcccccgttcataatattcatacagggaacgggcatgagagtagatttgggcccgagatactctgagagcagaacgtcttcggagtttgcagcagcccgtgcaactgccattgagaccgtaagaatggcatttgctccaagttttgccttgttcggggtcccgtcaagctcaatcatcaccgagtcgatacttttctgctcaagagcatcccttcccagaagtttgggtgagatgatgtccataacggcctgaacggcaccctgaactcccttgcctccaaaccgtttttcaccatctcgacgttcaaccgcttcatggatcccggttgatgctccggagggacatgccgcccggcctcgtatcccgttattcagggtgatatcgacctctactgtaggatttcctcgtgaatcaagaatttcacgggctattattctcttaattctggtgtccatcggggttcaccataaagagattggtcgggatataataaagggaaaactcatgtgagaattggagagcgaaataaaaatggtgatacagacaatatatgtgatgttccatctgctgtccggcgtccccagggggagttcccggactcatgtcttaatatgcggattctacattaaaattcttggactctcccgatagcagaataaactatacgtaccatataccatgaaaaaattaaacccaggacaggataatcacaaggaagcatccgggaaagactataaaaatatttttcaggaaactccggaaggtattatcatcaccatagaagtatcagccgggagtaaaaagtctctattccctgacggatataatccctggcggaaagcatttggtattgcggtaaaagctcccccggttgagggaaaagcaaacaaggcgatcatggaactcatcgccggatattttcacctgccggtccatgccgtcaccattctgtcagggcagacctcttcggtgaagaaggttagaattcatggtatctcgcgtcagcagataattgacatcatcaacgagtagaaaaccttcagactgatatgaccctaccctaattcttatatactttctggtagatgaatctccgtagatatgattcacattattatgaacaggggttcttacgtgtatgaacaggacacaacgaagtatcgaattcacctggttgtccaggctgacggggtggtcgaccgatctgatgtagtcggggccatttttggtcagattgaaggactcctcgggtcagaacttgaacttcgtgagctccagagacagggcaaacttggccggattgatgtcaagatccagagcaaactgggaaaatcatatggtgagataaccatcccgacctcggtagatcgggcagagacggcaatacttgccgcttccatggagactatcaaccgcgtcggtccctgtgtctcagaaatccatgttcaatcgattgaagatgtcaggattaccaaacggacccagatcatcgaacgggcaaaagctctcctccttgagtttgaagaaccagggattgatcctgattcactcatagatgctgtacgtgaaagccagcggatcgagaagatagcaaccatcggagtcgataacgtccctgccggaccaaacgtcctcgcatctgacgccatcatcgtggtagaagggagggcagatgtcatcaacctcctccgggccggaattaaaaacgctgtggctgttgaagggaccagtattccaaagaccatcatcgacctgtgccggaaaaagaccacaaccgctttctttgacggggaccggggaggggatctcatattgcgtgaacttcttgaagtcaccgatgtggattttgtcgcgtatcctacacggggcgagtcggttgaagacctgagtcgtaaggagataattaaagcgcttcgaaacaaggtgccggttgagtatgtcctggaagaccgggtcgcagagtacctggcatcacaaaaatctgaacaacagacttcatcaattcgtgagcctgaaccagagaggggaagtgaaccggcacgatatcaacaaccagcccctgccagtgatgcagtaatctcctgtgaatgcacggaagagataccggatgccgtctctgaagaagagagcgtcactgagtatcaggcgtatctcccggatgaggaggaagataaccggccaagaaccgtgtttacccatatcagggaggtaaaaaaccgtggaactgcacggtttatcggagttggcggtgagatgaagaatgaactccctgccggagaagttgaggagaaactcggggcattggaacagggccttgaggggattgtcattgatcaggagatcaaccagcagcttcttgaccagttctccatgcatggtatcaggtatcttgccgcaccctcatttaccggcatagtgcggcttccggctacaatacgcctcattccattcagatagccggtttcaggctatttttttatatttttctcactaatcagataatggagatccagtgtgcataaagaagaattgatatccctccataccatgctcaccaatgtccgcgagtatcttcaggagcagaaccctgatgcagactttaccgagtatgatgccctggaaattaccccttcacaaacccacagaagcaaaatagagcataaatatgcgatatttgtccttggaaatgccatcgcaaaggcaatgagggaggtagacaatccatcagcagcacgaatggctgaccgcatgcatgaactggctgagaggacactaaaagagatagaaatggaagggtaataccttctactttttttgatcctgggaaaccaggtactctgcaaggagccgggggatcggggcctgcatacaatgccagttgggtgtgccgtttacttctaatacgacgtatgatccattacaggacagcaggtcaacgcctgcgtaatctactccgacgacctgtgctgccctgactgcaatatctgccatctcctgtggaatttcaattgcactcccgcaccctccctggtggatgttatgggtcaggtgatcagataccctcataatagccccgactgccttgtctccaatgacaaaaacccggaagtcgcggtcatttggcacatactcctgcaggtaaaatggtggatcaccaagctctgcctcactctcaaccagatgaatcccaaccccgtcaaacccgtacaccggttttgacacggccttggtatgcttttgtataaacttccctgccagcgtccgtgattcggtaaagaatgttgcaggagtcgggaccccgtgctgcaccagaagggccgatgtcatcaccttacttgcacaggtgacaatactctccggtgagttaataatcctgtttttcagtgagagggcctggagtgattcaaaattatgaccattctgtctgattccgcaggcccagatggtcgctccggacagatcatctgaaaacggatcgattgcttctaaaaacctgacctggtacggataccccatccggtcaagttcatccatgaccatccgggttgaattgtcagatggaatatcggttggttttggaataatggttagcatggcacatcaaaaaagggaggttattcaaagggtctgctgtacttcttccagatctgttcacggaagaccggaccactgttataggtgcagaagggaatgagagtcccgtccggtgtagcataatgaatacagcactggctgacccgctcgacatcataattatagttgtccatgaaatgcatcatcccgataaagagggcattccagtggaactcacgtagggaatcaaagttatgggtgataagggcttttccaaggctggtccagagttcacggcccccttcctcgctcttcttcaccgatgcatagagttccttaatcccattaatggcaaccatcttcttgctgataggccctgccgatgagagctgggtcgtgagccgctcgatagaatcaaaaaacgcatcaacatcgatcatgcggttgatcgggacgatcttcttattcctgacaaagacataggttgctgcaccacaatgctggtgtgccgtaaaccggagttggggtttaccagtatatgcctctacaaagtcactgatagggactacacagggaaccggataaaagtcctctttctcaaccgacccttcggtctgctcttcaatacggtttagtatctcagggattgttatccgctgctgttcgatatcttccggtgacgccgctccggtaaatgagaccggttggaagttcactccacggattacatcaatattttctgcagcaaaccggacaatatcaccgatctcatgatcattatggcctttgatgatggttggtaccagtaccacaccctgctttgcttttctgaggttttcaattgctttcagatcatgcaccagtttgaaattcgtctcttttgataccccgtcaaagtgcaggtataccgtggaaaggccggcatctttgagcctgagtgcataatcaggatcctgcgcaagaatcagtccgttcgttgccagctgcacctgcatgaaccccagactttttgcaagttgtatgatctcaaacagatcttcacggagcgtcggctctcctccggcaaactgaactgccggcgcaggagttggtttttcagagcgcaggatcgtcagcatatccttgatctggtcatagctgggctcatagatgtacccgcatgcccgtgcatttgcaaaacagaaagaacaattcagattacaccggtttgtcagatccacattagcaaggagggtcgttgatttatgattgttacagattccacaatcatacggacaactgcttatatctttcacgacctgggggtttgcaaggcctgatcccttcaccccgaacgcctcatatctgcgccatgcgtctgcatcatcccagtacaggtatgaaaaatcaccatgatcaggacaggtcctgtttatatacacctttccttcgttctctataatctctgcttctagtacttttttacatattggacagagacttttcgtttttttgaggagtatactatcaccaccagcgggtattcccataccggattttacttctgctcatatgtatgcgaaaacctaaccttataggtatgccggattctgcaacaatactcagtaatggactcatattcatcggctctgcgatatgggtgatgctccccgcatacctgccaaataattttgcagcactgaccggtgggggtatgcccattgatatggggaggaactggacagacgggaggcgtatcctgggggacgggaagaccatccgggggttcgtcggcggggtaacagccgggattcttatcggggcagtccagatgtacgcagagatatcaggacttgttccctggtttcccccccataccctgactgcagttattctgcttgccatcggttcacttcttggagatatggttaagagttttttcaaacgacgtcaggggatagaccggggaggagagtggtttttggtggatcagctggactttgtcgtgggggcgttgcttctaaccctgctgtttgatccgatatggatgctaaacaccatgaccattccactcctgatcgtcattctggtgctgacacccctgctccaccggaccgtgaatattatcgggtataaactgggattgaagaaggtaccatggtaaccgctacattgcgtgagatgctcatatcagctgaagccatacgatttggagattttacccttgcgtccgggaaaaaaagcacggtatatattgatatcaaaaaagcgatcacaagcccggccattctgaaaaagattgcagcagaggttcttacccacagcacggacttcgatgcagtcgcaggtgttgccgtcggaggggtcccccttgcggtgtcagtctcccttgcctctgataaaccgtatgtgatcataaggaaagagcagaaaggacatggtcttgccagccttatcatcggtgatgtagctggaaagaggattctgctcgttgaagatgtcaccacttccggtgggtctgcagtattcgggattgaacagctccgctctgccggtgcagtcgtaaccgatgtcatagcagtagttgaccggaatgaaggtgctggaaaaacactgcagggccttgacatcacactgacccccctggtcaggatgcaggatcttataaatgggtgatcgacgggtgacagacatgccattatacccgtatggctaaggttagtctatgaaccggcatacggctggcatcgtcatacttctcatagccggtattctgggcggtattctccttggatatatttatcatggagatgcaccaggacaaatccagaataatacatcatgggcaaggcaggcaccagtcagtcagtccgacctgatacggccttcacatatcctgcccctttccaatgagtcatttttagtcagtgatctggatgacaaggccctttttctggttcaggcaaacgggacgatgcagagggttataaccagggatgtcgccaaaccctatggatactgggatatcgccggtttcacccatgataataaggggaatatatacatttctgattcagcaacccaccgggtattaaaactcagtgataaaggatctcttcttaccagctggggaggttttggagatgtggatggtacatttgacacgccggcagggatcagtgttgttaatgcatcaggtgaagaattaatatatgtttgtgattcaggtaatgcacgaatccaggtctttaccccgcaggggcagtacctccagagcctgcagatcccaaccgatgaaacgaaaaaagtcaggataataaaaccccaggaatcactcaatactaccgacctggagaaattcatagttactccgcaaaaaggagcaaatcctgcatttgtagagcgcacattttccattcagtcgtcaggaaataccctatcgctgacgtttgacatcaaccggtcggttcatctgggtgcacaaaaagtgtcattccaatcatcagatgtctcaacgaaaaatccggaggaatggattccggagctttctgctatccttgcagataaaacaactcaggagaccctgaagacaacattggaagaactcagacgccaggcaaatatcaaaagaattagtgatcgggcgaaatcggaatgtattgtccattttattcagcagattcctctgactgagaatgcagagaaccggtacccgatagagatattgcatgataaaatggggaatacgtatgacaaagccctgtttttatatggtcttctgagtgaggcagggtatgatgtcgtttatctcgcatacccgggtctttctcatgcagcggttggtatccgtctcaccgatcccctgcagagtacggcagtagccacataccgggatagcaatggcagtatatacatgtatatcaatccggatgggccatcatttatcgggggaattgcccagaaataccggaagagtgatccgtttgtgatccatcttgaagagaaagggaaagatataggaacgagaacaggaagtggaaaagagaagaagtccatctctgcagatcatctgtattcaacctatgtcgtgcagagtatcttttccctctctgaaaagtatcaatttctggtaaataaggagaaggatgtaaagagtgatgaggcacggaagatccgggagaattaccagaagataaaaagtgttcttgactttatcgagaaaaatccctggaacaccgagattgcctacatgagaattaaaaattcaaaggtaaatgatattatcgtgtagaattctatccagcccttattttttcccggaaaccaggtagccggtgaaggaaccaaagaataatcctttccggtccatttcggtgaggtgagcaagaaacgcatcagcctccttttgtgatacgcacccggcaactgccgcccgattcgcattttctgtaacggtgaagattgtttccgcttctttaagcgtggtcatgatcatcgtccgtggatagaccgttacatcggtaaatcctgcgttctgacacaaccgactaagttttcgtccgatatgaccgcaggcaaattgatctgaccagaagttcagaatagcccgtgttaccccttcatcaaccccgtcgatgatgaaattttcccaatccggttcaaacaggacacatcttccccccggttttaagacacgatacatctcgtcaatgacatgctggggatcttgcacatgctgaagaacccggtcttccctgaccgcatcacatacaccgtcacggactgccgagtattgcccgtccatccggatgtaggagaggttcggaatattgaaggctttttttgcaagggttacaagggaagaactgatatccgatccgattaccagtccttcggggctgcaccgtccggcaaggatatggacatcatcaagagggccgcacccgatctcaaggatgatatctccgggtgatatctgcaaaagctcgaatgattcttcttttaccgaccgaaagaagggatggtttctgatatctgacaggcaccggactagtttttcctgatcttctgaatggtccacctgccgaaatccggttgcaaggaaggtcataatgttagagaagagtgtggtttcatataatgtgaagggatcattgaacttcccagtgatcgatgttccgtgtcataggattaaaaatgatacctatctcaaagatcttcctgccatcgctttcatatttctcccggtattttttttccctgatctggttgagagggctgtcaactccaggcgaaggagaatctgaaactttaaattcaaatatccagataccggttttggtttttacggtaagatcaattctgcctttattggtagtatcttccggtataacctcatacccaagacttgcaaaatacgtgtacacgatactcgcataatacccttcaaattgcgacaactggttcttcctataccaatcgtgaggtattgaagcaaaaaatgaagaaaaaatggtatgcacctgactggggtcttcccgttcaagaatatcatagagcatttcacgatttttcgaaatctcctgttttgaaaggatttccgcgaacaaggtatttaaagaggttctgacttcgacattagggtatccaagccagcatgtaaatccccgaatgggatctgcagaccattttttaatcgtaagataccctgcctgaaaaagcagagtctctatcctgatatgttccggatcaaatgacccgaggagatcggtccccgcaataagatcttcgtagtcagccggaagtcgtgggtttgactcccagagtttgatgagaaaggtcggcgttccggtctcgaaccaatatggtttgaacgtcccttcatcaaaaagcaggaggatatcaaacgggttataaaccgactcaccggtccaggaatacccattgtaccatcgtttcacctcatctttatcaaatctggagaggtgctctgtaaaaatctgctcaagatctgtctgagtatacccgcatatcgcagagtatcgggaatcaagggtaatgtccttgagattgttcagaccagaaaatatcccggtttttgcaaattttgaaacaccggtgagcatgacaaaggtaagaaatggatcaagatctttaattatactataaaaactcttgagatcttcacgaaggtctaaggcaaccttctgattatgaaggttatcaagaatcggcttatcatattcatcaaccagaagaacaaccttatttccagtttttttgaatagttcacgtatcagatcttccagttgaaatccggacgagatggaatgatcaatggaaagcccatattgtgctgcctcctgggaaattattctggtcagatattcagataattctgcagatgaacggttcacccgttgtgcaaagctgatttttataacaggatattttttctcaaaatcccagcctgattcaggacgttcaagataaaggcctgagaacaattcttttttccctgtaaatgcacaggagagagtgtcgataaaaaggcttttgccaaacctgcgtggtctggagagaaaataatatgaacctttttgagctaactcagcgatgtatggagttttatccacgtagtaatacccttcgttcctgatcttctcaaatgactgaatcccgataggaagttgaagagagggcatatgaatagtacgtacttgtgataatgagtaattaaggatggtctttctttcctattctgacagggtcgtaccatggatttttaatgataggtttaatggtgtgtaccgcatattggtacgagaatattaatctaagatccgatatctatggcaattagtaccagaggaggcaatttttcactcctccacctgattatttctcatcccctctgcacgagtgcagagattttcattcgcagagcgaccaggatctttatccattcacatgagagagtgccccttttaagcactttctgaatttttttaaaattgatagaatgatacaaattcatcggagttatcaggaatgaatacacatacaaacatccttgttgtcggaagcggaggcagagaacatgccattgcaaaggccctttccaaaaatccacagacgagaatatttgcggtaatgaacaggatgaatccagggattgctgaactggcatataaggtcctgattgcttcagaaactgaccctgaagtggtgaaaaagttctgcatcgagcatcagattcagtttgcgtgtatcggtcctgaggcacccctggaaaccggcgttgttgatgcacttaccgcagccggtgtaaaatgtgttggtcctgcaaaaatggcagcgagaatagagaccgacaaatcattttgcagaaacctgatgaagaaatataatatccccggtcttcctgaataccatatcttccactccggcactgatgccgaagcattcctgaaaaccacaacaaaagaatatgcaataaaaccatccggtttgaccgggggcaagggagtcaggattatgggtgaacatctgactcatgaggaagcctgcagatatgttcatgaactcaaagggaatgttgtcattgaggaacggcttatcggagaggagttcaccctgcaggcattcgtcgatggcacccatcttgtcccgatgcctcttgtgcaggatcataaacgggcctttgaaggagatgtcgggcccaataccggtggtatgggatcctatactcttcctgatcaccggtttccatttgtcaccgaagaggattacaattcggcgtttgccatcatgaagcagaccattgcttcacttgctgctgaagggacaccgtatgtgggaattctgtatggtcagttcatgaatacggcacagggtccgatggttattgaattcaatgccagatttggtgaccctgaagccatgaatgtcctgtcattattgaccagtgacttttctacccttgttcaggcgattacgacaggaacacttgacaaggcggaggtttcgtttgcgaaaaaagcaaccgtttgtaagtatcttgtgccggaaggatacccggacaaccccgtttcaggcggcaaactgattcccggaccagataacaaggcactctgttattatgccagcgttgtccgggagggggaattcctggtgacccagagttcacggaccatggcctatgttggtatcggcgataccctggaagaggcagagaggattgcagaagaggccgcatctgctgttcagggccctgtccgtcaccgttctgatattgggaccagagaagttctggagaagagaatttcccatatgaaggagatcagatgaagaaagatttcatatccattcttgacatctcccgggaagaactggcaaatcttatcgcacatgccagaaaattaaaggaagagcgtagagtcggcatacagacccctgttcttgcccataaaaccctggggatgatctttgagaaatcatcgaccagaacccggatatcgtttgaggccgggatgtttgagctgggaggtcatgccctgttcctgaatccgaaggacatgcaacttgggaggggagaggcaattcgtgatactgcccgggttatgtccaggtttgtatcggcaattatgatccgggcgaaccgtcatgatgaggttctggaacttgccgcccatgccgatattccggttattaacgggctgtcagatcgggagcacccgtgtcagatcctggccgatatcatgaccattgaggaacgactctttcggaccgaaggagtgaaggttgcctggataggtgatgggaataatgtctgtacgtcacttattctgagtactattcttaccggtatggaggtcattgtggcttcaccttccgaatttgctccaggagaagatgttgtttctgaagcactccggatgggagcaaaggtcaggattgtgaccgatccacgggaagcggccactggtgctgatgtggtcatgacggacacctggatctcaatggggcaggaagaggagattgaccggagaagacagatcttcatgccctaccaggtgaacgctgaactgatggcctgtgcaaaaccaggggctattgtgatgcattgtctcccggcacaccggaactgggagatcaccgacgaggttttggatagtaaggctagtgcggtgtgggatcaggcagaaaacaggctgcatgcacagaaagctcttctggtcaggttattggcataaaagaatatcaatttcttttttctggaatttaactgattccagaattggaaaatctatatttttatgcgagattcagaaaaatacaatgttatttgatgagggattgaggctttttaaatctgctcattacaaggcatgattcgaacaatttgctgcgataacaaaaactgatgagaataaccataaagcttggaatgcttcggaatatgtcttttaaaattaggtcaatttgacaatgcatttttttgttttgaaaaagcattgaagctttaccccagtaataaaagggatgaaaagaaatatcatatcacccggattggcatctttggctcggttatacgagacgaagcagggccgggaagtgacaaagacattctggtcgatttcagcgatgatgccggccttcttgatcactcaggtctgaagatttatcttgagaaacataaaataagaattgggatgggacttttttttgtgaagataccaggcaggtatagaaaaccatgaaatatccaatggttattaaaaaggttcttgaataaattagagaaacaatccgtttaagatacactggcgaattctcaagccgagatttcccttttaaatattaaaaccgttgcgataacgccaaacacgatattcagataaaacattatcagcctccagagaataataaacactccaaggacggcggtcgggacaaacaacgcataaagcgaggttgccgagatttctgctatccctgatgcaccgggagttaaaggaatcatactgataagagcgatgatgatctgacttaacatggattccgatatggacgggggaagaccaagtcccataagaattactgatgctacaatgaattctgaaaaccagaaaagaacggagaaaaccgccccctgaataattcccttctttccatggctggtgaaagccgtaatgccagagcagaaattatcaaactcgacatcagtgctggcaatgatccggtgaatacccggagtcttcatctttgcctcaatccagtgcaaaagacgcatcaccttgtctttcgctgactccggttttcgtgctgcaaagaacagaactacaacaaacagaataagcactgccagggagaagaatataacaaaaacaataccttctcccatgtcccagatgaccttgcccattaccaggagactgaagactgtgagtgcaacgaggataactgcatcgagcacccgttccatgataacaaccgcggttgcatcaccaagcgacatatcagctttgtaaagctcgtggatccgaaccggttcacctccggcctgaccaggggttattgcaccgataagcaggtttgcaaccaccatattgtaacagtgactgtactttacctggtagcagagggatgctgccatgacctttattctggccgcccagagggagaatgagacgaaccgaagtccgattgcgatgagtaaaaaccagatattgatatgggtgagatattgaagggtatcctcgttaaatgttgatgcaagaataaagacgaggattgccatggagaatgccagagacagatagaaccatttcttctgtgttttgtccatgttttctctccgtggcaaaaattcctgcagatattaaatttagtactatatcttctttcgcgttatctattctgggaggagggaaagtcgctccagcacctcttcggccgcatcaatacccccgtccaggtacagagcaccggcaaatgcttccatacactctgcaagcactctgcctgatgtccagacatgcatccgtgcttcaccctttccccatctgacatactgctcaagatgaatagaacgggctgcatcacggagtactgacatattgacgagatccatcttcttgagggataccgctcctttgtcatgctcaccccccttgacgagcctggtcaggataataagctcaataacggcatcaccgagcgttgccagggcatcaagatgggaatcttcagaaaggccctgctccttactgtaggcaagtctggtcagtgccctgagcaggagggacttgtccctgaaggtataaccggtaatccgctcaagctgttcgggaaataattcggcagtcatcagttaccgggatccaagcatctcgcagattgaacgggctgcctgttttgcccctcccatcgccatgatgaccgttgctgctccggttgtgacatctccggcagcaaaaatcttcggatgagaggttctgccatcttcttcggtgaccacatttcctgctctgcctttatcaagaccagggatctgactcacaaggaccgggttcggaccctgcccgatcgcctgaatgacgacatcacagtcaagggtaaaggtgtcattatcgattggttctgggatcggccggccacttttatcaagattacacatctgcatccggatacattcaataccggttaccgcctgttcaccaaggatccggatcggatttgcacaggtaataaactcaataccctcttcttttgcatgatggacctctgctgcacgggccggaaggtcttcttcacgtctccggtagacaagggttacctgtgcacccatccgtcgtgcggtacgggccgcatccatggcaacattcccgccaccaacgacgacaactctgttcatttttgcaaccggggtgtcatattcagggaaccgctcagcatgcatgagattgaccctggtcagaaactcatttgcagaatagacaccgctcaggttctcgccaggaattcccataaagtatggaagacctgcaccggttccaagaagtatggcatcatactcttccagttcttcaaatgagacggttcttccgaccagatggttcaggcggagatcaacacccatcgcaaggataaggtcaatctctgcttttaccacgtctttaggcagacggaatgaaggaataccataggtcagaacaccgcccggtgcatggagcgactcatagagaacgacatcatgaccgtcctttgcaagttctccagctgcaacaatgcctgccggtcctgaacctatgacagcgacccgctttccggttgcagtctttcgtgcagggacagtaagaccctttgcccgttcctggtcggctgcaaaccgctcaagctgaccgatccggatgggagtatctttctttccaagaatacacaatgcctcacactgggtctcctgcggacagacacgcccgcatatagccggaagaaggttctgctgcctgatactctctgccgcctctaagaatttacctttcgcgatgagggcaacaaaggcggggatgtctatattgaccggacatccgtcaacgcatccgggttttttgcactgaagacaccggcctgcttcttctatggcctctttaggagagagcccgttatctacctctccaaaatccttcaggcggtcagcaacgcttctatctcccatttaatgctgccctccgcaggtacactggtgttctttccataatgccagggcttccttctcatgctccatgtaatatcgctggcgttgcatcaggttgtcaaagtcgacctggtgagcatcgaattctggtccgtctacgcaggcaaactttgtctttccatcaacaacgcatctgcaggacccacacatgccggttccgtcgaccataatggggttgagcgagacaaaggtcttaatcccctgctcacgggtcacattggatgtgactttcatcatgatggttgggccgatgatccagaccgcatcaaccttctcttcaccgataacctgtttcagaaggtcagctgcaaatccgtgatgaccttttgaaccgtcatctgttgctatgagaagtttgtcacatatctctgccatctcatcctcaaggataagaaaatctgcattccgtgctccaagaataccaataacccggttaccggcatcttttaatgcttgtgcgatgacgggcgttgatgcaataccaacaccaccgccaaccagcacacaggtcccatatttctttatttcactcgggcatcccaatggtccggcgatatcgctgatggcacctccggcaggaaccgcagcaagggcatgcgtggttttcccaaccgccatgaagatgattcgaaccagatctccggaaatctttgagattgtcaggggaatccgctcaccggtctcatcagtccgtatgataacaaactggccggcctttgcattccgggtcacatggggagcgtttacccatatctcatagacattttcggataatttgagagatttttcgattatatacaccagatgtcacatccggaaaaaattattcgggcccttatttattgcccgtccagcttctttactttacgcacccggacagcaacaccgcgggaggatcggatcatttcatcagcactcatgactgcccgtccggttgtcatggccttatctccgatgaccagcacttcatcaccagggcggatgaccgggtcggcatcaatgacacctggcgccaggatatcaccctggggcacgaactcatcgatatatacccggtacccggtttcaatgagcgaccagccttcaaaggtgggtcttatcagaccgtgagcggggtcggttgagaagtagagatttctgccccgctttaccacctgctccggatatgaaccttttacttccaggtttggcgccttgagatcatacccgaactggaatgagatcatccccctgaccaggtgcgatttaacctttcgctcaccggaaagggcctcgcttaatgcctgaagtgatgcgggatcagtcagccggtctgtctcgcaggtgaattctatctcaaatcctgcctgatctgcagcatcctgtgcaatgattcgtgcatccccatccagatgagcaatgacccgacggtagggatgtctggtaaagtacctgacaagagtatttgtgatctggtaccgctcctcatgatcccaatacccggtgaccggcacatcatatgctgcggcaggataacagagctcaagatcacggggaacaagtcccaggggagaggtcatgatcagttcatgtgcccgtcttccgatggcctggctgaatttgcgatgagactgggagaggctgtagggtttttttgctgaacagggaatcagaaccgccacatctgctaccggtgggatataccgctcaaccagccggtctgcaaaccgtctgacttccacccggtgaatgctgtctccggatgttgcaaggaagggcacagtacgggataccggacaatactgctccatccggtctgacttatcaatatgacgcatgatcgagacaaattctggttttgtcctgcatcttccctcaagaaactcacgaaatgtcccgtcgcggatcctgcgcccgattctcgccagttcctggtcgagtgcgatccggttatgcaggaggagatctccactcaggcatccctggcaggaacagagtccttcttccatcactttttccggatactgtccgtcggggagacagaatttctcctgggtcgttgctaggtcggttgcgatgtaatcaaagagatcaaaaccagcatgaaccagaattgccgcattttccggtagtgctgcaccggggagataccagcaggtgtccggcggtgtggaggctttcagttgatccaggagctgacagaagtctcggggacgggagagcagggtatgccagttcggggtgatgaccgtatctcctgactgaatattgactggtgcatgaatatggagcggtattggttgttctccgtcacggatcaggaaccgggatacaaaatccggatcctcgatcggcgggatgtttgttccggaccgggtattcagggcaggaaagagcctggtcgtatcggtagcagacgggaagttgagaatagtatcgtccacggtcaggcgaccataccgggctgttccgtcacggctgaggatctcaactcccttcatcttgcacctccacggtggggagaatctgtgttatcaggtctttccagaccggacgacacctgatggtgaaatgagagtccgggttcgtctccatgagtctggcaattccgatacatccggttttaatcatttcctcgtcaaaatcagggatctcactctgcccgatggggaatgtttcggtgagttctgccgggaagggaccgaagggaggcttgaagtaaaatacggaatcatactcctcggtctgttttttcttgatatgccggctgaagctgatgagagtccgctctccggcggttagccgcccaaccatctggtgataccgcacgacctcggtccgtttgcagctctcatcgccccggtaaaagaaccggcgtttggtctcacggtcaagtgcggtgagttcttcattatacccaagtaacgtccggtatccccggagcagggctggatgagaacggcatcgttcatccaccagttcccagagcacaccgtcacggattgcctgcctgacacggttgatctcggcaagagagactcgcaggttatgcatggcaaggagtcgctcccggtcaggtgattcattcagttcctttgcggtatgaccgacacagaccggacaggggcagggaaggtaggagagttcgttcaggtgataactcccatgggtggtcatgtaccgtccgtccttagcatagagggcataggctgcagaatcaaagagatcgcatcccatcgctaccgccagggcaaacatggacgggtgaccggctccaaagagatggacacagacggctggagaaagaccgcgttttgcagccatcaccacctttacaagttcagcataccggtaggattccatgagagggacgacagcaccaatgggacagaaccgaaatcctgcctcagacagtctcctcccggtttcttcacgaaggtctggaaacagaccaccctgaaccggtccggcaagggtgtggtgctcatggtctgcaatatcttttgcctccatgatccggtccatcgtcaccgatagttcctgttccacttgttcccggggagagtcaggatgagtcggaatatccagcgggacgatgatatcggattttatagcctgctggaatgcgatggtctgggcattggttatctcaacttcgccatagaccgagagctgaaaagatccagagtcggtcataatgaccccgtcaaaatccagggtctttgcaagaccatcagtaagggcacgctcacgatactcttcagaccgggagaagatatatgcattggtgatgaccgcttcaacgcccatctcctgcatctcttttgggggtatcaggttcaggtgcgggttgataaccggaagcagggtcggggttttgacgatcttgccttgtccggagagttttccgattcgtccggctatgtctttttctaaaatttcaaaggagagggtcatatatgaaaattgtttcgcattattgtagtctccagattatgctcgcgatcgcttgtgtgagaggtattggttagctaaacgatcaggtacgtattatttgtgagggttcactgattggtttttcgtataggagtggggagtaggataaactcattcggaaattacccacaatgtcaaaccagaataggaggggtacatatggaatacaccatttataaaaccttcaattttctcttaaaatgttttgtatcctttttttcttagagactgcaaaaacagatatccaatgtccgcatacatagaagttagggatgaacagaaaaccggttttccgaataggaaccgatgactttaaagaactcatcgatgaaggaggctatttcgtagataaatctctgtttatccgtgaaattattgatggaaataaagtagttcttcttccccgtcctcgtcggtttggaaaaaccctgaacatgaccatgctcagatacttctttgaaaagacggagaatgaccaaaattacctttttgaaggattagccatatcacattattctgaataccagaaacaccagggacaatacccggtaatattcatcagtctgaaggatgtgaagggtgtatcttgggttgagagtagaagacgattggttgagaaaatcggtgaacttctcgcacagttcaaatatatcgaaccgacactggatccaatctaccaggacgggtttcacgctatcctttctggaaaccccgatgatgcctctatgaaagccagtcttaaaaacctcataacatggctttacaattatcatcagaaacccgtcattgtcctcattgacgaatatgacagccctatgatcgaagcatggactcatgactactatcatgagatgacagagttcatgcgatcatggcttggcggtggactcaaacatgagaacgcccatgctctctaccgggcagtcatcaccggaatacttcggattgcaaaagagtcgatattttctgacctcaataatctcaaagttatctccactcttcagtcccacaaggtatcacagatgttcggatttaccgaacatgacatcgatacaatcctgtctgatttctcgattccggatcacggaaaagtcattcgcgagtggtataatggatactcctttggagatcaggtgatctataacccctggtctgtaacgaattacatagataatctacctaatccacccggccctcactggctcaacacctctgctaatactcttgtgtatgaggaacttggtcgcggaggaattgaaataaagcgtgatctggagaaactcctttccggagaagagattaggtacccgattacagaaacaattaccttcagggatatcggaagaaaccctgcaaatatatggagttttctgtacttttcaggatacctcagggcaggagatccgaaatttgcagattatgatccgaacctcctcacatatgcattgagtattccaaacaaggagatttcggcagcatataaacaatttgtaaacagccaatttgagaaaggagatccgtcatctggtataacctcatttctctcagtatttctggagaacaaaaaagcagagatacttgagcagactttacaaaacctaaccatcagtcttgtaagtttctatgatcttgcacgactccctgaagcagtttttcatgcttttgttctcggtcttctcgcaaatctgatatcagtctatgatgtcagatcaaatgcagaatccggacttgggagagctgatatcctgatgatcccaaaaacaaccaggtatcagaccggatatgtgatagaatttaaatcaatatatccgaatgatgatatcgagaaatcggcacaggaggcattaacgcagattcgggagagaaagtatgatagttcattcatatccggagggatagaacctaatataatccgatatcttgcggtcgtggttcagggtaaaagcgtaatggtaaaggagtggtttgatacctaatcaaattagaacaggtaatacaggtcaatatttcagttaatttaattcaaaccccacttatcagaaatactacacgtggtatcttctcctgcagatatcttttttttaatcgtattacccaatagccaattatcccggtattcaaaaccgaacataacgtttttacattccagatttgggcagcacttatttatgtgacccatccttttctgaaaatatctgcccttcaaatgtgaatatctgaaccgacgattcctgccagcatcctctgggaagtcctgccttcatacacgtatggtcgagaaactcagtcacattccatccccactccactggaacctgggggagtagaagaccggaccggccataccctctgacaataagaccatgttttccaactgtgatcgcagccggtctatcagcaggaacgacatccaatagttcaggttcggtcaggactgtcacttcaaccgaaatatccgaaagttcttttggtgtaaccggtgggaaccgaggatcgccggttgctgcagagcaggcagcttcacggatggcatcccggagtggcattatggcatggggaaatccgatgcagccccgaagatcgccatgcttggtcagcgttacaaataccccgcgtttttttgagaagaccggtggaaattccggttctgtgtagggttcctgtgctacatgttcatgcagtacatggcgggcatgagagagagcaagtttcccttctgctggtgtaagaagctccatgtatgattgatagtccctgacagtatttatctgtcaggacaaaaaaggaagatcagaatgagtcaagaagtgacttcagacctgctttcccaagttttattgcaagcttgggatttgctgcgatgatattttttataagatttaaggtattgaaatctgaaaggttcatttttgagactgagtgcacaattgcattcaggtcatcatcattcaatttgacgaatacctctttaatctggtaatttctctcaagcgcctttccaagatacgatgctctccatgtctcgtcatagggcatgagtgcctgagtagatgtatcgcctttttcaatagccttggatccaacatctccggcaagttttccggtatagagagcggcatagataccaccaccggtgagaggatcagacacacgggctgcatcaccgacgatcatgaggttgtttgcaactgtgcatgggagtggctgacagatagagacaccgccggctatcagctcgatggtcttaccattgggaaaattcctggcgacgaaacgattcaggtagtcaatcggccgatttcctggtttgcaccggtctccaccgacaccaatacccacgttagcggttttgtcaccttttggaaatatccatacatagccacctggagcgatgttgttacccacgtagaactcggttgcatgagcatcgatgtcaatcccggtcatcagatactgggcacaggtctccatctcacgaagagggaccgttgtgtcaacaccgcaccagcgtgcaaactttgactcaacaccgtctgctgcaatggtaagtcctgcccttacttcttgagcaatgcctccctgattaagaatagcaccctttaccgctccatcctccatgattggggtaactgcacgggtcttaacctggatgtctgctcctgctccggctgccatccagacaaggtcccgatcaaataccttgcggtgcagaacatagccgacctctgctcctgccttttccggttcaagttccatcttaaacccgtcaggtgctatgatattggccttctcaatctctgctgcaacccaccggtcttcaggcttgaagaactcatgcatcagggcttttccgactccttcggcacatctgaccggagcaccaatggcagggcgtttctcagtgagcaggacagaataccccttctcggcaaaggtctttgcagcaaatgctccgccaggacctcctcccactacgagaacatcatactcgcgcttcatttcttcgcctccaaagccccaagcggacagacacggacacagatcccacaattcttacaagtattcgtatcgatatccagataggcatcgacaagttccagtgccccttccggacaaaccgagacacaacagccgcaataggcacagatttcccgatgaacctcgatcattccttacatggttgacgcgaaatcctttaatgattcgggtatggatcatacagatcagggatctcaaatgatccatacttcccaccgccaccgggatgaagaatgatatgcccctcgcgaaatgaccggattgcttttgaaaggcggatatttattgctgcaatctcttcaggaggagttttcataagagtagtaatttcgtcaccgaaccggtcaatacactgacaatagagatctctgcagcgccgggttgtcgggcttttcgtgtcaaggacacgctgaataatttcagaaagggggataatatgaagataaggcggccgctctgatacaggacctgatgaaagggattgtgcacgctcctgaacgcctttttttatcctcccgccatcatcagggcatttccatgaggtcgctgctgcttcttcaaaggagaactggcgaaaacatctgctacatgcggtccggttatattttccttcctctgggaaaaatccgacattcatcacgatattcgcctgctgaacggcagtgagcacaccgatggcatctgatcttttcagttccaggacggtgaactctcttcccagctttgatggttcaggactgtgagcatcagagttggtcaggaagggcacttttgcaagctcagctatgcctgctccatacctgctgtcagccgacagaccaagttcaaggagatcgacctgttcatgagcatagcaggatgagagtgacggatgcatagcatatactgacgtgtagggagtaaatgcatgggccgggccaccaatacctccgactgcatggacatggaagaggatctcttctccggacaggggtacacgggggcggccatttgaatccatgtccttgctatgtggcccgagcctttttgcaagctctgctgctgcatcaaaatcagggagcagaatcacatgatggacccggcctgctccttcaatttccgtagtgggaacaacgatgatatcatcatcaataggaacatcctgccacatccgtctccattcaggatggagaacatcaccggttccaataacagagattcctttgactctgcagcctttgatgatctcttccggcaccatccggggtgatgatgccatggaaaaacaggaatgaatatgaagatctgctgctgcctgcatattcagccgatgtatgaaagttcttcctcggactttctctcctgctctaaaagccgttggagggctacttccatctcacctgcccgttcggtcagctttgcatcatctatctcaatccccaggagttttgtcagaactgagagaaccgtcgtggcactcctgggatcgacaaggtatccggatgtctcgcccatcagacagattccctctataccaagtggtattgaaagaccaagcatgagtcctgctgcaccaataatgccgccaccaggctctccttcgctaaaaatccctccggcatcctcaacctgctgtctgagatcctcacggttcacagccgcaataacccgggtaacctcgttgaaatgaccaataccatacccgccaatggtgtaaattcgtctgactccaagctggtgacagatatcaacatagacctgggataaaagataatgaccttcaccggaagtactctgaaaatcgccgactaggaagagatacgtacctttctcacccgaataccggtatatctcattattacagagacggactgttcctccttcctggatgataacctggggagggaaatatatggagttgatttctgcaatccggacagccccaagctcctggatcatgtgctctgcgacaagttttcccacatgcccgattccagggagaccttcaatcatgatcggagcagtcctgtcttcaggagctattgattcctcaaatcgtatggtaatatcttccatcattgcagtaatccttgggtgttcaatgaatgtgtgttatctgatagtgttctgattcttttgtaaaaatcagcgaatcatcctccggtattttccatatcgatcatcaggagaatacctggcaggatggggagttattgtgggtttcccacaactggaacaagtttcagaaagagtgtaaagattatccgaggggcagtatctgatacgccctttcatacatgcttcccggacttcgatttccggctgaattttccttctccaccggctcgtttcagaacaccgatggctgcacttgaggccttctcaagagccttctcagcatccttataattcgttgcaataacctttatacggtaattaggcgctccaagataggttatctctatctctgctccgtctaccttcggctctgcactacgaagggcacgtctgatgatatttaccccatctgacttggtagaccgcaggaacaggtctccggagatggtaaccgatggtagttttacattttcggttgcaatggtatacagggcatcagcaagcccggagtctattttaagtttattcagggcatcacggccttcggtgacaaagtcctcaaaggctgcgtacaactcaccatattcacgatagagtgcacttgcaatatcctgggcactatcagctttgccagctgcttcagccgcaaaaccgatccatttttttgccttggattcattcttccagacacggatcttctcacggcgctggtgctcgttgacatcctttaaagagagatcgatgtgacctttctgggggtcgacattcagtaccttgcatacaaccttctgtccctccctgatgtggtcacggatatacttaatccatccacgggccacttcagcaatagggatcagtccctcccggttgttatactcgtcaagcgtgacaaatgccacgaaatctttaacattctgaactgaacagacgacaagttctccctgttcaggccactctctctcctgcatcaggctctcactcaaatgcagttataatctctgctttgatttgtgcttttccaccggtcggggtggcaaggtttgagccacaaacaatgcagtcaaccggcgtgcatgcacggtcaaagatagtctgttcattctcacagtccgggcattttaccttgacaaacttgctccgattctctcgtgttaattgtaccattataattactccgtaagttcgaactttccaaccctgaatcctgctctcaggtgtgctttcttgcatgcagtgcagcggtaccggatatttactttcttggtcggcttgtcgcctccgggaactttggagaatttacccatattcccaacctgtcctctccgtgctttctggcgatcaatccagtggagtccggtggttttacctttctttaccttctctacctcatgctcctcatgtttgtgacagaagggacaatatgtgcggaattttgctggcatcttcatgattttggccactcctcgtgtatagaatacctacatcattagcccggatgtatatttaagactatgtcgcgttcaaccaggacttgtgcatttcttgaggggagcgtgagaatatctcctgcttccatctcatatgtccgtccgtcaatacccataaaaggttccatgctggaaagcgctaacacgatatcatttgcaaaaggagcgtctgatgaggtttttatcacgggttcaggataatcggactcttctgcgcggttaatatcctcaagagcggcaggttcagagacctcaacgcacaagttctcctcatcatgtaccacgcggacctgccgtccaggagttgccttccattcaatgagctggcttttgctctgccggatcgcatcaactatccggttaaacatctcaagttcggcaggaatgagtgaacgaagctcctcccgctctatataggatccctcggcctggctgagcgcaagccccacgatcttgtccgtccggatcttgaacagttcttcaaccgttgccctgacgctggataccttctcgatgagcagacgggcctcatctgaaaacggatcctcatgactgtagacctcctgctgaagggaccggatgtgctcggaggttttcaggaacaggtccggagatatcatcgtcagttcaccggtatcacgctcttcaagaagaatggtgcggagttcatcaagatgcatgatccaaaacccccccgatctctgccatccctctgcagcagagaaatactccaacggcttccgggacttttaaccggcctttcgggatatcgtatgatgatccaagaagggagaaggagtactcccgctctgattcgatgatgacctcacgctctccaaaagcaactgcatcgataagcggatcaaaatcatgaagttccttcacctccatcggaaccactttaaaaccggattttgcatgaagggaaccaggtagtcggataagccgccgggtatccgtagtaaccggttcatcagcctgtactgcagcctccctgatatgagggagaagggtactctcccgctccgaagtcagggctccaaaaacggtccttaccgtctggtcacggagaaggatcgatgagggattggtattcagcagcgtgatgagttccggtatcattccggcaaaccgttctgccatgacctgcccgacacctcgtaaggaagataattctgctttcacttcttttatgggcctggtgctgagatcctgaagatacctggtgagaacgagtctgaaacggtcatgccatccacgtctccccggtttccagtcatgaaggagaagagaaggactgataccggtcccgcagacataatcaaccagctcccgccgttcagccggttcaaaatcacggaatgccagttcctgaacatgaacatgataccctcgtccccctgaaaagaccagctttatcgtccgcatgtcaattcccagctcattgtcaaggacatccagtaatttctcagcctctcccttgatccgctcaagcatcgcttcatacgatccccgcatgatgtgatccgcatcaagatcaaagatgagatcagcccccagccattctttgtcgcccattgtcggagcctgcggagtccggtaatatgctgttgagtagtacgcatgggcagggaccagacttttcacatactcctgcatctcatccccggatgaaaacccgatatgacgcctcatcctgatatcatcagggtaccggtcatcaaagaagataaaaccaaactccctctcctttactgatgaaggaggggatattctggctttatcatagtaatcggtaaaccgttgtttaataaatatccgggtagcaggtctcattcctcacagatccttaatcatataggggcctttcctgaaatacccaagtttctgatagtagggtctgaccccgatccctgccatgatcgcaacatggctgtatccggcatccgctgcgagcgtctctgcttcagagagaagtcgtgtcccgaaccgtctgtgttgctgatcctcacctcttccttcctgcccgatcgggaccaccatcccatagacatgaagttcacggacaaacgcagcattctcagtctccggtcgccagggttctttggggaaccgcagccgtgcgaatccgaccagcgagtcatcagattcaaatgagataaaccgttccatacccccgcagcactcatagggcagaatattcaggaccggctcagcctgtgatcgtctcctgcctatctccctgcacctgatacatgagcacctgccacctctcttgtgcagacgttgtttggccagttcccggaagtttgaatgaggagaccctgccacgatcttatctgcaggaatgtcccgctggattcgctgaagccggcaatatggtgctatctccatctttgcatcggccaccagatcgatgaggtcgtcttcatcatatggtgcataagcccccgattcatagagctcttcgatctttgatcccggtgtcacaaggcacggatatattttcagaaaatcaggtctgaatcgtggatccgcaaagagatcatggaacatctgccggtcagatgcgaaggtgcttcctgggagattgggcatcatgtgaaacccgactttgagaccggcatcacgaagaaaggtatttgcttccacggtatctgcaacggtgcatcccctcaggttcagggtcaggatttcgtcgtcaaggtgctggaccccaagctccacctttgtcacgccaagatcaagcatccggtcaatatgctccttccggcaccagtctggccgggtttcaaaggttatcgccacacaccgtactttggcggtttcatttctggcaaatatctcctcccggctggtgtcgggtaacgggttatctgggtattcattcattgccctgatgcattcggtcacaaaccattcctggtatgatggctcccgggcggtcatggtccctcccatgacgatgagttcagccttatccacgtgatgcccgagctcctcaaactgggataatcgtgcatgcacctgatcataggggatgaaattgtgtgcaaaggcacgttttgcggcaggttcgccaccggtataactctggggagattgaaaaagcgaatccgggccacccggacagggaagacagataccatgcggacagggggccggtgatgtcatgaccgcgaccggggccacaccagacagagttcgtgatggttttaccagaagaacaggacgaagcagcggatactcctcaggggtagcgcaggatagaatatctgagttccggggaacaaccggcagatgatattttttgcagatagtcttgactatctttcgaagttctcgctcaccgggaggagtggagagaatgagagagattatctcccggcaggcgggggtgatgtccatgaaattagttctcaacagctatctcagaaggtgtggacatttcatgggaaaaacttagcatcgccggcttacgcccgatgtgatcgacaatctcctgaccaagaacaagaatagcctctttatgagactttttgtttttatgtatgtgcaccggtgaaatatgcaaactattataccgctctgttgggatttcctcattggtgatggtttcgtagtacttcctgacatgaataaacagcatatgtaaatgtagcagctcctctttctgcactctatcacctagaacagtcacttggcatcttcaccggggataacatataggttatgggaatcttttattaaagggaagatgcagaggggcgcataaacctctagctccatgaactgaacctgtttttctgcgcaccagagagagaacatgctccagatcttattcagggtgtatatcgtggcaaaccttccggaaggggaacaaccctcaccaaaacaggagacggccctgttctgcacggagcagcttcaccttccagcacatcagtaatgatgtatttttgtccctctacgactccaatcggatgacatgccgcaaaagtttcacatgcttcatcacattcaggaaacttcactacaatcgtggtattttttctggctatatcaggagatacacgcatttcaaccggggcttccgctacatcaaccgtgacagcccccccatggtgaacaggacaccggtgtgaggctgcacgtatagctaccacttcataccggcggcctgattcaaggttatgacagacccgtgcaatagtgcatgactcacattgatctgcccggcccatgtagacaaactgggtccctggctgtgcatatactgacccgacaatggttacccgtgtttttttctgctccatacccttactcctcgtataacatctgcaccagatgctctgctgattcccgtgtcagtcccatgtcaaggatagtgaaccgctcaggtcttatatcccgtgctttcatgagtgcctctacgatcacctcatcaggaatgttcagttcccggggagtggttggggcacctatcctggcaagggaggatctaatctcccgccagtccccgccatgcagatacatagtcattattgatccgattccacatgcctcgccatgcaatgctgcccctggcatcaaccgttccagtgcatgaccaaatttatgttctcctcctgatgccggccgtgatgaaccggcgattgccatcgacacccctgatgaaacaagggccttgactacaatccaggctgcctcttcctgacctggttttatcagattcgcgtccttgaccagtatctcagcggtcatctttgacaaggcaatagcatattcgctgatctgttctcccctcagccggtgagccaactcccaatcaagaatggcggtgtaattggagatgacgtctgcacatccggatgccataagccggtggggcgcctgggaaataatccccgtgtcagcgactactgctatcgggggatgggcaccaactgaaacactgccagtctcggtgggaagggttgcccttcctgagataattccatcatgcgatgccgcggtcgggacgctgatgaacggcttaccctgtttgtacgagacaatcttggcacaatcaataactcttcccccgccaacaccaataaggaaatccgctgaagatgaggcctgactacaagcttcgagagtatcagcatccagttttcctgcaacaaaacgtctgacttcgtactgatctttcagaatatccgcgacggtatttcccgcaacttcacgggtggtcccgccggatatgagaagaactgatcggccgggttttatatccgcgatgatgtcaggaagttgcattatcgcctgatgaccaatcagaacgtcccgtggaagctgggtccatctcgatttattgaagccatccggctgcaatacctgtaccgggtctgtgctcatggagttctcaacacatgattagggaattcatctacaaatattacatagatcccatccgttatggtcagccatatactctggttgatacccttacttatgcactcatcctgctggtatgtatctggctgatttaccgatggcttgaagcaaaccatatctctattgatcgggagtttgtatactccctgattccgtgggtggtatttggcggttgtctgcgggttgtcgaggacaccgggtatattacctctgacctgcatgtgatatttacaacgccgctgatcttcttcctgatattcgcactggcaatgccggttctctttattgcaaatatttgtgagaagagagggatggttcagtcctggaaaaagctttttcagtggaccgggatagcacttactctggtaacacttgggtttctcacctggtttggtctcacaaacgcccatattgatacactggtcggtctggcaatccttaccatggcaaccgttacaaccggtcttttatatactctcatcaggtatggattcgggtggcactatatgcaggaccgtctctatcagatgctgatatttggtcatatgctggatgccagcgccacctcatttggtattgacctgcattcagttccctacattgaacaacatgtggtaggatctgctctgattgacctgaccggtactgcgttcgttatgtttccactgaaactgcttgtgctgattcccggtatttatatcctcgaactctaccgccgtgaaggcgcctcaggtatctggtacctgattctgctcgccatgatcatggtcggtcttgccccaggcatcagggatatgatgcgaatggtgctttatgtctgaaacgtttaaaatttctcattacctggctatttcaggaataattcttatagccggatttgcagcaggatttgtattatcatattttgatccggcatttggtgagtcactagtcaacctgtttcaggagatggtagcaggtcagataatgggtgatgatccaccagtgctggctctccagttatttctaaataaccttgaggcatgtgtcgtcatctttatcggcggtgcattcttcgggtttatctctgttgcaatactgatgctgaatggtgtgatcatcggtgcagttctggaagttgtcagaaaagaagcagggtatatcgccctttttgcagctattgttccccatgggatctttgaacttcccgctgttattgcatccggagcacttggactgatgatggggcgggcagtgaaaaatgagttgtcaggaatttcagatgcatcttttgaggcatggcgtcttggggggtattttgtgaaatatataatcccgttcgttgccatcgcagccgtaatcgaggcatttatcacaccggccgtcttacaactggtgacataggagctcatgaatggaggaacaggaaggaacgctccctcaaaaggcagatttctcaggctggtacaatgatatcctctggcgtgcggagattatggatgtccgctacccggtaaaaggactgtatgtgtggttcccgtttggatttggtatccggaaacgggtatatggtattcttcgggaattacttgaccgggaccatgaggagacattgtttccgcttctgatacctgaaccggaattcatgaaagaggctgaacatatcaagggttttgaaaatgaagtatactgggtcacccacggaggaacgactccccttgatatcaaactcgcccttcgcccgaccagtgagacggctatttacccgatgtatgctctctgggtaagatcacatgctgatcttccgataaaagtgtaccagattgtcaatacattcaggtacgagacgaagcatacacgcccgcttatcagactccgtgagataacctcatttaaggaggctcacacggtccatgctacctgggaagatgctgaacgtcaggttgaggatgccattgcacgataccgggaattttacgatcggctgaatattccggtcctgatatcaaaacgtcctgactgggataagttcccgggtgcagattataccatcgccgtggataccatcatgccggatgggagaacgcttcagatcggaaccgtccatcatcttggcgatcacttctcaaaaacattcagcatccagtatgaggatacaaaaggccagcagcagtactgtcaccagacctgttatggcatatcagagcgatcaattgcagcccttatcagtatgcatggtgatgaccgtggccttatgctcccacccgaagttgccccggtgcagatcgtaatcgtcccggttattatgaaaaagcgggaggaagagatcatgcaggctgcagaactgcttgagaaggagttacagaatgcaggataccgggtgaagattgacacccgtgatctcagacctggtgcaaaatattactactgggagatgaggggagttcctctcaggcttgaaatcggaccacgtgaccttgacaatggtgttgttatgggagttctccggtctggcggtaaagagtcacttccacgggcagatatcattgctgaggtgaacaggaagatgactgagttcacggcaatccttcaggagcgggcaaaaacccatatcaaagatcatctggtcatggtaaaagaggaatctcttgtgaatgagatggtttcaaaaggtgttgtcgctgttcactggtgcgggaaccgtgaatgtgccgaccggcttgaagagatcgctgatgcaagcgttctgggaactgaagtcaggaccgatcttatcgatcagactcccggtacctgtatcatctgcaaaaagcctgaatcagtggtcacccttatcggcagatcctactaatcttttttcgatacccgtatagactcgtaatacctatttcctgtataatgacattccaattccctgctgcactcactattgccggatctgacccttctggtggtgcagggattcagatggatctgaagacctttgcaaagacgggagtatgggggatggcagtcatcactgcactcaccgcccagaatgcagcacaggtgaccggctcatggccgatggacccggaaatggtaagggagcagataattgccgttcttgaggacctgacaccgggagcgataaaaaccgggatgcttgcaaatacagaaattataaaggcagttgaagaaaccgttcccaaagatgttcccctggtcattgatccggtgatgatctcaacgtcaggataccggctcctgaatgatgatgctatctgtgatatctgtgagcgtctgatacccctggcacatctcataaccccaaatattcctgaagcagaaatcatctcccaaatgaagatcgcgtctgatgaagatgtgattcttgctgggagtaaaattatggatcttggagcaaaacaggttttgataaaaggaggtcatggtaagggagatgatgcgattgactaccttatcatgaaagagggaaacatatcctttcgtcataccagattaccatatgatgttcatggatccgggtgttgtctttcagcagcgataaccggatatattgcacaagggtttgatgatatatcatgctgcaaaaaagcaaaggacctggttacttttggaatccggcatgcatatgagggaaaaaacaaacataaaatgattaatccttagaatattcaaaaaccaagataatgatagccgatctgcatgcatgagccggcaatgaatcatatatcaatgaactgttgctcatggctataatgagtgggtaatcataccccgaattacaccatacgtctcaatatataaaggatctccacctcggatgagactatttatagctgtttcacatatagacgacatactggttcaggaacctgatctgatccactcatatgaacgtatgatttatacatccaggggttatcatggaaaaaaaatgggtatattcatttgcagaaggggatggaaaaaataaacagttactcggtggaaaaggggcaaatctgtgtgaactaacacaatcagggatcagggtacctcccggatttgttataactaccgaagcctgtctgtcatatctgaatgaccctcatcgcacactacctcatgatctgatggaacaggtcaaaacccatcttcgctctgttgaagaggcgatgcaccgcagattcggagagaagaaaaaacctcttctggtatctgtccgttctggctcagccatgtccatgccaggaatgatggataccattttaaatctcgggttaaatcaggacactttggaggggcttattcatgataccgggaatgaacgattttgttatgatgcatatcgccggtttatccagttatttgggaaagttgctcttggagttccagatgaattatttgacgaagcatttgaacagataaaaaaacaggcacaagttacccaggatattgatctgtcagcccgtgatcttaaggatatctgtaagaaatttctgcaggttgtcgagcgttacaccgcaaaacccttccctcatgatcccaatgaacaactggagatcgcaataaaagcagtatttaattcctggatggggaaacgggcggttgactaccgaagggaatttaagataactccggagatggcgaacgggactgcagtaaatattgtcgccatggtctttggaaatatgagtaataattctgcaaccggggtaggatttacccgtgatccagggaccggggagaatgtcatctttggtgaatacctggtaaatgcccagggtgaggatgttgtcgcaggaatcaggacacctaaacccctggcggcaatggccgatgagatgcctgggattttcaaggagttaatggaactccgtaattcgctggaatcacatttcaaggaggtccaggactttgaatttactattgaggaaggagtactctattgtcttcagacaagaaacgggaagatgaatgcaaccgccatggtcagaacatcggttgagatggtgcatgagggacttatagataaaaatcaggcactccttcggataaaaccggatatgcttgaacaactgctcttcccaagactggaccctcatactgatatgcagccggttgcaaaagggcttgcagcctctccaggtggggcatcagggattgcgatttttgatgctgatcgggcggagaagatggggcataatggccataaagtcatattggtcagagaagagacaaaaccggaggacattcacggatttttcgcatcccagggaatactcacaagccggggagggaaaacatcacatgcggcagtcgttgcaagaggtatgggaaagccctgtgttgcaggagcagaagggatcactgttgacgttaaattacgtcaagctatcatcggggaagtcaggatatcagaaggagatatcataaccattgatggatcaaccggtgcagtgtacctaggagaagtgccccttattgaagcggaattttcctctgatcttgttactcttctctcctgggctgatgagaaagccagacttctggtcatggcaaatgcagatacccccgccgatgcaaagcgtgcattaaaattcggagcaatgggtattggtctttgtagaacggaacggatgtttaatgatccagccaggcttcccatcgtcattgacatgatcattgcagatacaaaggaagaacgggaaaaagcacttgataaattacttcccatccagcgggaggacttcaaaaatattttttccatcatggcaccacgaccagttactatccggctgcttgatcctccgatacatgaatttttaccccaggagcagcaactcatcgatgaaatagatattttacgtaatctgcgtaagaatctccggggtcttcgtgttctttcagatacggtctcattcatgtatcagaatgatcctgcccatccaaaggtcctgactcctgcagatccggaacttcttgatgcagtcatattaaagaaagagatgatgctgagtaaagtccgatctctgcatgaggtaaatccgatgcttggtcaccggggagtccggctcgggcttaccttcccggagatttattccatgcagattcgtgcaatccttgaggctgcagcagagtgcagaaaagaggggatcgatgtccatccggagattatgatcccccaggtatgtactgcccaggagttaaacagggtaaaggaatgggttgctgagattcacaagcaggtagaggacgcatatggtctgaaaatctcctgttcctttggatcgatgctggaggtggtcagagcctgtatgcgtgcagaaaaccttgccgaagaagctgagttcttctcattcggaacaaatgaccttacccaggcgaccttctcattctcacgggaagatgcagagaataagtttctgccgatgtacaacatgaatcacatccttcaggataatccctttgaggtacttgatgtgaaaggtgttggaaaactgatggaactggccgttcaatgggggaggacaacacgaccgggtatgaaagtaggtatctgtggagaacatggcggtcatccggcttcaatagagttctgtcatcagatagggctgacctatgtctcttgttctagtccacgggttccgattgccagacttgcggctgcacatgcagcaataaaatcaagataattggttttcatcttttttaatacgtctttttcttcggtaccttgatgatatctgctgcacttccaaggtcagactgtacctggatgaaataattcgttgccggagcggtgctctctaccttcccggtcgctgtatcaatatctccctgcagactgtcaactcctgctatcgttgcatccattgcccgaaggaagaactcccgtgattttttatacgtgtcagaaagggtcatctgttctgctgaactcttcgcctgctctgcaaaggtcttcattgccgagagatcatcgatcgtcatgcccttgtagggattgataatcttttcattttgggggtccaatttttctatggcttcaataaccagggtcttgtaatcttcatcatgagtggcccctgtacatcctgctgtatataagaaacaaatgaggagaatcggaatcagaaataaatgtcggagataactcatgatatgggtttctgtttttttccttaataaagtctgcttatcttttccagatcactattcaaagagccaaacagagaatcgcagtcaatagtagtgttaaatcaattgtatctgcacaatacaacatatcttcagaaccaatacctggcaataactcaggggattatctcataatgaaaatctgctgcgaattgtggcataaaaatattttggaaaaaccgaaataaaaaaggattattccaaggcatgaacatcaatgagctcacagtaataagcaaacgttatgaattatttctgaaagttacgcatattccatgattgtcgggatcacactgaattcttaatgacaaaaacatcgcaatatctaattccacgtaatgaccagtatttctatccagggggaactacttattctatgaccacatgggaagaatcagcagacgtagtatttaaaaatgggattatgttcaacccatatacctgtgaatgggtatatgaggattttgctgtcagaaatgggataataatcggtacaggtccgggatatacaggaaaagaagaggtagacctcaaatcctcctatgtctgccctggttttatcgatgctcatgtccatattgaaagttcattgcttaccccgtatgaatatgcacggctggttatgaagcacggaacaaccacggttattgcagatcctcatgaaattgcgaatgtaagtggaactgcagggattgaatatatgcttcaggcacatgcagatcagccattggatatcatggttatgctgccgtcctgtgtacccgccaccccacttgacgaatgtgcaatgacactcacggctgatctgcttcggccctttatcggtaaaaatgaggtactgggccttggagaaatgatgaacgtacccggcgttttgtcaaaagatccccttgttatggataaacttactatgactcccatccgtgacggacatgcaccttttctgaccgggccaatgctggatcagtatattaccaccggacttcaaagcgatcatgaaaccacggtattgaacgaagggaaagaaaaactacaaaagggatgttcctctttatcagggaaggctcgactgaacgaaatctgcagacgctcatccctctggtaaacggatgttcatcatcacgctgtagtttctgcaccgatgatcgccatgctgatatgttggtaacatccggccatattgacgattgtatcagaaaagcaattgaatttggatgtgaaccggaacttgcatacagaatggcaacgctctcacccgcagaacggtttcgtttgtatgacagaggtgccataagtccaggtcgtattgctgatttctgtgttattgaagatttaaagaaatgcactgtccattccacatataaaaacgggaaactcgtattgccagaacaattcagatctgaaaaaaatcatacgataaaaaactggccattccatgcaaaaaccccctctatggaggatatcaggataaccggaacaggcatcgcacgggttgtccggatacaggaaggacagattggaacgaaggcagagtaccttcatctgtcaagtgaagacattcctgatctgaaaagagacatattaaaaattgtcgttgtttcacgctattatccggatattatcggcgtgggtctggttcaaggtcttagacttacccggggagcaatggcatcaagtgtttcacatgattcccataatatcatcgcagttggtacaagtgatagtgaaatcatctcagcgattgcttccgtgataaagaatacgggagctatggttgtacgggatggagatgaggaggcatgtttacctctctctttggctggattaatgtcagaattgccgtatgaagatgtatgtagtgctttagagagtattcatcaccttacaacagcctgtggtgcgatacgagatcccttcatgtacctctcatttctggcattatcagtaattccagaattacgggtaacaaccaggggagtttttgatgtaaaccggttttccactgtacctgtctttattgatgaagaagaatcaggaaaaccctgatcactttattacgaagtcgagtgctccaaatttttcagaaaacgttatttgaagagattaccggttgaaaatcccttcatcaaataatcaccggttttataatatgaccggtcaagggggttataaaagaagaaaggtgcttcctgcagatcaggcttcccatctgctgtcagatatgagtcatcaataagaacatccacaacctcagcaacaaagagatcatgtactccgacatcaactacgtgtgtgatccgacattcgataacgaggggaaattcatcaacataaggggcatttaccgaaggggcacgaaccggagtaagaccggtatcagaaaatttatcccggtctcttcctgatgatacaccaaaataatcagcctcttttacatgggctgttgaaggtatgcagatagtacaatctttcttttctatcagagcctgataagtatggcgggtccgctgtacggaaaatgagatgcttaggggatctgaactacagactccgccccatgctgcagtcataccatttgcttttccggtggtatcatacgttccgataatgagaacaggagttggaatgattgcaggtttcttcccgattgattgtttcataccagataatgggatgtgaatacagaaaactgataccctggtataaatgcgaacagatattaacggccgggtatgattcctctatcaggactataccatgaaacatcaacatgttgatctgaaatctatcgcatgggaaactatggagaggtatgggtttactccccggtttccccgtgaagtcatccatgacacgaatcacttatccccagaacatcatataaaaatcaaaaaaggagtcaaagacctccgagggcttctctggagctctattgataatgcggattcagaagaccttgatcagattgagtttgtgaaagaaggagaacatggtgagattcatgtgaaagtggccatttcagatgttgatcattatgtgaccaagaattcctcaatcgataaccatgcaggacataatggaacatcggtttatccagggattgtaacctttcatatgctccccgaccggctttgtaaagggattacctcacttcttccaggtcaggactgttatgcaattattattgaatacatggttcttccagatggagaagtcagaccaggagatatttaccggggagtggttcggaataaggcgaaactcgtgtatgaagagatcggagactggctggaaggtaagatttcggttccatcacgggttgcagagacagatggtttgaaaaagcaactggaactacaaaatgaagttgcagtacgccttcgatctcatcgaagaagacaaggcgccctggaccttgaaactcttgaggctcacgtggtctctgatggtgaaacagttactgacctggtaatccaggaacaaaatgctgcccgttgtcttattgaagagtttatggtcgcagcaaatggaacgatggtggcttttcttgagaacgccggtctgcccatgatacaaagggtcgtcagggttcccaagtactgggaggagattcggcttgttgctgcgaaattcggagagaaacttccattcaatccggatgcaaaatcactctcatctttcctgataaaacagcgtgaagtagatcctgagcgatttccagatctctctcttacggttgtaaaactcatgggttcaggagaatatgtcccttttattcctggtaagactcctatcggacactttgctcttgcagtcaccgattacacgcatggcaccgctccaaaccggagatatgttgatcttatcatccagcggctaatcaagtctgttcttctgggaaccaaatccccttatcatgtcagggaacttgaggaaaaagcagaatggctctccggtcgggaaaaggcagcaaataaggttgaacggtttatgagaaaatctgccgcggcagttcttttaaaaccaaggattggagagacttttgagggatttgtaaccggtgcatcagaaaaaggaacatatgtcagacttatccgccccccggcagaaggaagagtaatgcgaagagaatctggtcttaaagtggggcagaaagtgatggtgaaattattaaagaccgatccgtataatggccatatcgattttgaatacctgcatgatgctggaaaagtatagagaaaaaatattttcgaccattttttatttgacggtgaatgaccgaattgctgctgcattatccggataaactttaaaaattttgaacaaccctgataaccggagtatatcagatacatttttatttggggtagaaaacagaagctcacctttcttttccttcagagtcttggctgcagcaataaaaacacgaatacctgcacttgatatatatcgcacgtcggtcagatccagaataatccaacgcattccctgattaattccttctatcaatgttccttcaaggtcagatgatgtcgtggtatcgatagaacctatcggatgaaaaatccacatttctccctcataccagatatcaatggggagagcagaacctgcttccttttttaatgtatagataagatctgtctcgacgtcaggtgatgccatattatatccgtacccatatacgagaatggagatataaagatgcaggtatgagaaatcatggaatcgtattatatatcgaaggatggaatagatattccataaatagattcagtcacaaatggttgatcacatatggattcatcagagagtttatatcagatctggtatgagctcacctccgggatagaggatggtattgtaattctaaacacattagatatcatctgtcacctgaacaaaggtatttctcagttatttccagtcaccagagagaattatgtcggcagacaatttgatgaattcattgaggaagttgttcttccggtgataaaaaacgcagatagtatctcaccgaatggatatcaccttatttcttccaccctgaaagaccaagatctttatattttttccggacctggaaagggacagtctgtagaattttccattctggagaagaatgattctgattaccattggaaaatggggtatttccggagaatcaccagatggaaaaagactgaagaactcttaatcaggatagaggagcgattcagaattatttttgaaaatctttttgactctgtcgccatgtatccagttgatgaatcattttatccggggcactttattgaagctaattcatcatcggtaaaaaggctgggatacacccaggcggaacttatgaggctatcgcctgcagacattctcccccctgaagagtttggacgttttttatcattcattaaaaattttagaatttcaccagttcagaccgcagaattttcagaagttacaaaagatggaacgatcattcctgtcgagataacagctcttgttgtaaaaatccgaaacgaagaattcataattcagatctcaagggatatttcagatcgggttaaaatcaggcaactccagatgaatgcatttgaacagatcaataggaatattgaacagtttgcaattttaaatgatcggattcgtaatccattaagtgttatcctgacacttgcatcattctctgaaactcctgaaagcaccagaattgctgaacaggtacatatcattgattctctggttgatgaacttgataaaggatttattgaatcagaaaaagtcaggaaatttcttgtccgatattttcaggcagatacatgaaattgagaatcaatgatttatctgtaatttgtatccgtttctttctatttctgccccattattttttcctttggtgcatattgttcttccaccattctcttggttcatgatcttctgagcagctgaccgaactgcattcatatgcgaatcacataccccatacacaaccggtccaaatgaactcataccagccccggctgcaccggcatcaatcatggcatccataatttccctgattaccgggggctgaagacgtagttcacatttcttaaagccataattctgaaattcatttattgcctccccaaactgttccaaatcttcttcaaccactgaagggatcagtttcatgagaagaatgtgagaaagagcctggacctcatgttgtgggacaggacagaaggtctgaaatacatcatgttcaaactggccatggatttctgcgaatccttctggtattgccagtacaaaattccaatcgttcggaatatcataccggccgaccaggggagcaggacctgcaccagaagataaggctgatggtgcaaacgaatccttttttctacctggcccaaaccggtgaccggcatcaacaaggaatcctcccatgaaaaaagctcttgttccaatcccagatgttccccctcttccagaaatagcaatcagttcatctgcactcatattttgttcagaaaatactcctattcctgccgctattccaagtgctgcctgggtcccgctcccaagaccatagtgaaagggaatggattgctgaatatcaatatgtactggaggtattgataatccattggcgattaatttttcaaggattggctgcacctgatatgatacccctggttcttgtgatgtcagagaaaatgtatctgactctgatatttcaatgataaaaccgggatctttcagagtaattcctgcaccaccatcaaccctgcctccggaaccattcatgtcaagaagtccgatatgaaggcgggaaggtgtgaccactctgacagtagaatcatcaataaaaagggaggagggaatttgttcctcaatataaaatataggacgtgaattatgaattatccggtatgatctactcagacaatgacaggttcttttatttgggatctggcattcagaaggaagtaatttcttttgtattgacaggatttctctccgtgactccatcttttcatcacgcatgatgaaaccaattggctcatcttcgttcataagccgggtcattgccccgggtggaagatgtttcaatggtgcatatgaaatggcacgtatcaacagacggtcattatttttattatagagatagacttcccgaaaattcacatcttcaccgggtagaatctcaagatactctgcaattttttctgatgctggaacaatgttctgctgaatagttttaacaccaacaggcgcatttataaatgcctctaaaagccgggtgacagatccatctgttatgagaagagcacgttcaggttttgtcagtacgcatgattcattttctatctgctggataagttccaggaccgatccctgtgtcattattacaccaatatcagagtgatgtgtatagaaaaatgtatcagattcctatgataagaataaaaaagtttcataaaaatagactcatcaaactgcatccgaaatctgtacgattattccggggttaccagaacagatctgtacagaagagactatcctagatgcatgtttcgctgtgagacagatagtgcaccaatagaattgtaacctggtgcaccataagtgtttcggctctttcatatgaaaatgtaattacaattttcatcagtagaaaaggctcattagaatcatattatcatcatggggggttcatcataagatttcaatatttgtcatcgatcctgaatagaagaatggtcaaaaggataacaggaacattatgtgcaccaacaacaaatagatatggttcacctataagctctgtatgatgatgaatctaaacaaactccagataaaaaaatgaataacacaataattaaaaatatagccgaaattgaacatcagccttatgaattaatccggaaaggaatagaaaccggatccattgcaatcatgtaccgtggtaatatgggaattgcaatcggaacaggactcaggacaaaaataaatgtaaaccttggtacctcatctggtcattgtgtcccagaagaagagattcaaaaagcgaaaattgctgaactttatggtgcagacactattacggacttgtcaaccgctggagacataccagaaatcagacaatcaatacgtgatgtcacatcactccccatgaccacagtccctctctaccaggcggttgcagaaaatacccttgattatctcactgatgatctcataatagagaacctgaaagaacaaatcaaagaagatatttcatcaatggtccttcattgtccctctagacagaccataaaggcaatgaaacagagttcccgcataatgggagttgtttccaaaggaggcgcaatgatgagttcatttatgctaaaaaataatcaggaaaatccctatattacacattttgatgagattctcactatactaaaatcgaaagatgtcgtcctttcactcggaaataccatgagaacaggttgtatccatgataaccgggatagtgcacaggttctggagataaacgagaatatcctgctggcacagcaggctcatgagaaaggagttcaggtaattattgaaggagccggaggacatatcagagccgataaaatcgcagaaaatataaggtactacaaagataagacagattttccactctttgtagcaggaccacttccagcggatgttggcatgggatatgatcatattaccggtgcgattggcgcaacattcgcagcaggagccggagcagattatctctgttacatcactagggcagaacataaaagtcttccgactcctgatgaggtcaaagaaggacttattgcattccggattgctgctcatattggagattcaatgaaatatggattgtctgaaaaggacaaacatatcgctgagaaaagagcgcaaatgaattttgaggaacaggcagcatttgctctggacccggaggaagcaggacggggtattcctatggatacaaattgttccatgtgtggatctttctgtgcactaaaaatgattcagacctattgtagaagaactgatgaatagacatgagttcaaatcgtcaacaatatcctgatgaagtctacaatcaattcacacaatccaaaactctgtcattttatttttttcgaatgaacaggtatataaaatctcatacattctattcttttaagggtcgaattggaatgggacagggtaaggcttgaatgagcgatggtatattattcacaactacagatgactgctcaagcattaaatttaccatctcattgtgacctacatgtctgaaatctgtccgaagtgcaattatttttttcccaagtccaaatgcatatccaatctcccaggaagttccagaatctgcatcagcaccgtctatcacagcaacaacaatatcagcattgtgaatagcttgtacatttttttcaaatatttctctttgaatagataattcccgtgaatgttccgaatctccacaatcctggggaagatgaacctgcatagcataaccagttaatatatccgctacttttctattgaaatcacactcagcttcggaaaataaaggtgcagcaagataaactttccaacaggctgcttcaaagacatcaaaggccattatatctgaaaaacgttttagaaagaaccctctaccaggtatctttccgttagagccatgaaccgatccataccaggtatttcgcaccccacaaaccggagatgaatcaactccaatgatcgcatatggacgaccatcacttttccaatcttcgcggacattggtttcaagtctgcatataagatctgaaaaatccggattatccaatcgaccaagataatgccctggctcatgatcaggccccaggtacatcgtctctgcacaaggaagcattttcacaggtattttaaacgtttcacatcggaataaaacctgagaaaatgcatctaaatctttttgatgagtgattcctcgtgcacgaagttctggattttttatgcagggacataaaagaagatacatcctgtactaatcatcacaaatgaatagatataatccctgtgcacatatgagaaaaaattgatggtgaaattaattattacatcagtattcagggacagttcttatctttctggcattttataccctttatttgagagttttacaaaaaaattaagagccttatgtattggtggttcgcatttttctaaaacgttcgagtaattcatggagaagtgactttgaaggcaaaagaagtaaacccgcttccagatcaaactccgcgcaatgcatgtccgttttgaacaaaagaatctgatccagttcttcatcaaattcctgaccagcaataacagactgaattactgcatgaggcatgtcaattaccatagatggaggtgagggaatgagcatgagagataagagatttgcacatgcatcaaggtaggaagaagtcataatatttccaatttcatgaagcatactcatatccatttcatttatttcccgatcttcatctggagctccaagcattatcgatgataaccggagtatggacttttttggaacatgaagaattatcgagccatttcctgaaacctgaccacgaacctggaaaacaaccatagaagcaacggaatcatcaagataattctgaagattttccaactttaccatgataattttctgaactgaaattgaaacaggtactcctataagagaagagagagcaattgcagcattttgtgctccgctgtctcccaattcccataattcatctgcctgttcagtggtcaggatttctgttccatcagtaattatttttgaactcattttcatctcaatactgaaactttattgctcttagtatatctgattgaccgtaaaaatgaaagtaatccattaattttctaatttattaaattacctgagtgaatatcttcttttaacaaataaacccctgcaatgagaacggccattattactgataatccaagatagtggtatacttccgtttcacttatgtttatgacaattatatgccttattaaggcagttaatgcaacaatgagaagagcccgtactggaactctttttgtctttaaataaacagttacagtttcaaataattcaatgataatgatagtaaaaagaatcgaataaatcacctgtatgatcccttcttcccaatgcatagttgccaaaattactaaaacttccagaaaggattcaatcaatgataatattgcgattattgaaagtaatatcgctacacctacatatactgcaatagaaatcgtagaaaaggtattgactaactgatttgcacgttcttctgacaattcaggcatatcacataatgaattataatataagaaatatcttttgataaatatattataaggagaagaaatcccgaaccattttatacctgtaaagtgaattttttcttattacgtgcaaatatcgcctccgcaaagaaatatattgacataacaatacaagctaaagaggcaaccattgttggtaaggttctctcatcactggcggaaccaagtaatgtaccaataagaaataatccaacgaaaactagggttacaccatcaaaaagatacacaagccattcatattcttcaacatttctgatggcaaccatgtaatatcggtacaatggattatcttttcaaaaaaaactatctgaataattttttaatttatacaaaagagtctctcgttgaacaatagcagcgaggatgatttcccgaggactcgcgtacctcagtaccgtcatccacgtgaggtgtcttaacttccgtgttcggaatgggaacgggtgtgacacacctgctgtggccgctattgatagccaaactccgggttcgaaccggaattgagttgacctgctgtcaaccgcgtgactgctcagccacttggcctggcttggatgtgtggaagatgcgagatataattacaccagcgtttaaggatttcgtctgggtttgagaaacatgaattgacgttattaagacgattagtattcgcggactgaacacgtcgttgccttcgtgcgtacatcccgaacctatcaaccgggtcttttacccgtgtctttaatgaagtctcttgttcaggctgagtttcaagcttagatgctttcagcttttatctcttggcgcgtagctgcccggcgttgccttgtcagacaaccggtagaccagtggcgccgaatgaaagttcctctcgtactatttcattcttgccttcagacttccaacactccttatagatagtaaccgacctgtctcacgacggtctaaacccagctcacgatcccctttaataggcgaacaacctcacccttggctgctgctgcacagccaggatggaaagaaccgacatcgaggtagcaagccgccgggtcgatatgtgctcttgccggcgacgactctgttatccccggggtagcttttctgtagtcaatagccctcatcaacagggcgtattggttcgttagacccgagtttcctctcgcgatttcttgctatgcgaaatcgcgtcaggccaacttttgctcttgacactcttcagcgggtttctgacccgcttgagttgaccttagggcacccttgatattttttcgagggtgtggcgccccacccaaactgcctacctatcgatgtcctgataaatcagttagaattacaataaaaccaggatggtgtctcatcggtgactaaccaacccccacaagggttggatcgacgtctcccatctaccctgcgcaggtaataccgtaacccaacgacaggctgcagtaaagctccacggggtcttcacttcccataaggagtcactagtctctgcactagtacaaaaggttcaacgggtatgtgttagggacagtatcgctctcgttattccattcatgcaagtcgccaattaagcgacaaggtactacgctaccttaagagggtcatagttacccccgccgtttacgagtccttcgtccggttgaacccggtgttcagatactcgcactgggcaggaatcacagactatacgagtcctttcggagttgcagtctgctatgttgttattagacagtcggagcgatcttgtcactgcgacctgcccaatcgctgggcaggcaccccttatcccaaagttacagggctaatttgccgagttcccttaacacatttactcccgacacgccttcgccttctcagcgaggggcacctgtgtcagttctcggtacggaccgtatcacccttttcacgggctcctggaatcagcattgttaccccatcaccgttttgaaaaattctcaccattacggtactccaatttcatatccggcttagacggagcgatgactccgcaatgcctatccgaaagcgtcaggattgtttgatacaggtacaggaatattaacctgtttccctttcggcgtactcgaattacggtacgtcttaggaccgactaaccctcgactgacgaacattgtcgaggaaacctagcccctgcggcggattggattctcaccaatcttaagcttctactactgccagaattttcattcctgcacggtccacaggatcttgcaaccctgcttccgcccatgcaggacgcctctctacgccatcatacttgcgtatggtccgtggtatctgtggcaggcttaagccccgtccattttcagcgccctgaatcttgactggtaagctgttacgcactttttaaagggtagctgcttctaagctcacctcccagttgtctttgacccaggactactttcagtgtttacactgagcctgcactgagggacattaaccacggtctgggttgtctcccttacgcattacaagcttaccccgtaatgcggacttccgatcgtctctgatgacagggaatttggagtttgacaggagagtgaggaatttcttccccagcttccccaatcagtgctctacctcactgtcgatctcagatcaggtcatgctacggcatgtttcgagaggaaccagctgatgcccggctcgattaatctttcactcctatacgcaggtcacgcgaatgatttgcatatcaaaaccgcttgcggtcctccacgcacctttcggcacgcttcaacctgcccacgcatagatcgccgggattcgggtcttatcctgctgactccacgcactggtagtacgtcgtccctgaccttacggctgcggacttgttggtttccctctggcttctttcatagaaattaaccgtcgccaacagaataaactctctggcccgttcttcaaaacgtacgatacgacaccggcaacaaaacccgtacttgagtctcgcaactcgttccttcgctttgaagatcctttcgtgccgtatcacgcgataacctgtcagtttcaggcacttttcaacacctttccagggttgcttttcagctttcgctcacgctactactacgctatcggtttcggggagtatttagttttggaggttgatgacccccacattcacgcgggaattccgacccacgctactcaggataccgctaaagtctgcatgcatacacatacgggactgtcaccctctctggtataccgttccaggcaacttcagttctgaatgcaaatcttatgccgcggtccatacaccacatctcccgaaggattcggtttgaactctgtcgtgttcgatcgcctctactaacgacatcccggttggtttcttctcctgcccctactaagatgtttcaattcggggcgttccctttccgatggcggaatgatgctttatgcatctggatgtcctattcggggatctccggttcaatgactccatgcgtctacccggagcttatcgcagcttggcacgcccttcgtcggcacccgaaccgagccatccactgacaggcgtaagaacgtctttttgtagtttcttcaaacccatgtaacgtccagaaacgcctagtgattttctctacgcatctcctctacacagcgtatcatcgccccggtttcacggggtctcaagcccttccccggttctgtcgccagaccgggtgcatcgaaaaataccagtggacccgtggggatttgaaccccaggcctcggcgttgcaaacgccgcgctcttccagctgagctacgagccctctgattccattccggaacactgataactctatggtctgtctccatctgccacaactttcatttcgttaggaggtgatccagccgcagattcccctacggctaccttgttacgacttaaccccccttgcaaaacccagattcgaacatatcactgatacatcctcatcaagacctcactcgggtggtttgacgggcggtgtgtgcaaggagcagggacatattcaccgcgctatgttgaaacgcgattactacggattccagcttcatgcgggtgagttacaacccgcaatccgaacttcggacaggtttaggagattatcctcacctctcggtgtcgaaacccattgtcctgtccattgtagcccgcgtgtagcccggataattcggggcatgctgacctaccgttgcccattccttcctcccctttagcagaggcggtccgagcagtgtccccatcaacccgaaggtcaagctggcaactgctcgcgtgggtctcgctcgttgcctgactaaacaggatgcttcacagtacgaactgacgacggccatgcacctcctctcagctagtcaagtagagtcttcatcccgactatcatgcagctgtcttatccggtgagatttccggcgttgagtccgattaaaccgcaggctccacccgttgtggtgctcccccgccaattcctttaagtttcagccttgcgaccgtactccccaggcggcgcgtttcacggtttcccttcggcacctcagtgacacgtggtcactgacacacctaacgcgcatcgtttacagctgggactacccgggtatctaatccggtttgctcccccagctttcgtccctcactgtcggacccgttctggtgagatgccttcgccataggtggtcccaccgggattacaggatttcactcctaccccggcagtacctctcacctctcccggtccctagaaatacagtttcccctgaacgcccaccggttaagccggcggatttctcaagggacttgtatatccagctacggaccctttaagcccagtaatagcggccaccactcgagccgccggtattaccgcggcggctggcaccggtcttgcccggccctttcttcaccagttatttacactggtggacagccagcctgtgctggcactcggggtttccttatcacggttgcccgcatggtaaagttttcgcgcctgctgcgccccgtagggcctggattcgtgtctcagaatccatctccgggctcttgctcccacaacccgtaccgatgacaggcttgttgggccgttaccccaacaactacctaatcggccgcagactcatcctgaagcgacggatctttcgttcgcataacattccagtcagcacgaactatggagtattacccccagtttcccgggattatcctcctcttcagggcagattgtccacgtgttactgagcagtacgccgaggtcttgcacctctcgactcgcatggcttagtcaaaccccgatagcagtggcctctggcaggatcaaccagaatttctatttttctcgcacactgtatctcttaaagtattggcagatgcagacagatatccacattaccagtattcctatgtcagaaccgatactgcaccacagtgcattcgtcgggtctccattaaaacggcctcttacgttgctcgctgaaggttatatactttcgtatcgcccttcccgaacaatcattcccaggccgccgactcctgatgtttcaggaagcgtgtgggataacaaagttgtaatcatgagtatttgtagttgtcgaaatgattctgatgatgataacaggccgtcagaaactaatacaaccgtataacaatactaaacattctcaaaaaagacctacaaagaaggtatggcgttgtgttgatgcgaggagtagcagacatgaatactaacatatcagcttggtgtagattacaccatacctctctttgtggtattacatactccttttgtatcagtgaacgtataaggtttcttattcgtaattgaaaattaatagacagattttggagaaataaagcatcggagtgatatttaaacatttttgctttaaacaaaaccctgtattcatgcagaacaaaaaatcagaattgaaaataatctacaaattcttatttttcttttaaaccggctgcatttctatgataattcccaagctcactctttagcagcattcgtcctgaaaaaaccggtccgtctttacaaacgcatacaccatccgggtcgatacaacatgacccacataatccaaccccgcatttcatataccgatgcatgctgaactgtgattttccaatggcattccggttatcaagaacagacaacacagaacgcatcatcggatcaggaccacagactacaatggtctcatattcatcaagatcgatttcatcaagcaaaccagcaacatacccatgaaaaccggcagatccatcatcggtcgcaacacggacatcacacgcagatgaaagaatactcaggaagatcagttcatcagctgttctggcaccaagaaggaaggtaacatcaggatactcaagcccgatccggagaaggggagctgtcccaactccccctgcaatggcaagaattcttccctgaagggcaaacccattcccaaatggcccccgtatgccgattttgtctccaggtttcatggatactaacgctgatgttgcctcacctacgcgctgaacggtaactgcattggggtatgacaaagccattggaatctcatcggtgcccacaacccagaccatgacaaactggccgggattagcagagaaaatatgatcgaaaaagatagtactgactccaggactctcctgtaccacacgggtgatcgtcaccgggaccggaagaccatcactcatgggcgcaccccacaatttcacttgaagaaataccgtcaggagcatataattcctcgcagatatgcctgaaaatttcaggatcctgaacaacagcacttcctatctcaacaccttctgcaccggccatcatcatctcaatgacatcctcagcgcaggaaacaccaccacacccgataatcggaatagaacaggcctcatagagctcatacacacaacggacagcaatgggaaaaaccgcttttccggagaggcccccatatttattcccaagaaccggtcttttaagacctgtagagatccgcatagcgcgaacggtattaatggcaacaattgcatcagctcccccttcttctgccgccctgccaatagcagtaatatcagttacatttggtgttaatttgacccagactggttttttccacacctttactgcttcagtgcaggctttcaccacatctggattagtcccaatctgtgcaccaaatccggcagcatgcgggcaactcacattcagttcaaacgcctgagccttctctgcaaaccaaccggccacctcatgaaattcctcaggattacctccaaatatactcacaatgacaggatcaccatcaaatgaagacagttcctgtatgaattctctggagggatttggaagacccattgcattcataatcccgtcttccagaacgacaacacatggccccgcatgcccatacctcggctctggaccaattgatttcgtcacaactgctcctgccccctggcgtaatatcctgcgaagagaggaagcacaggtccctagtacgccagctgcgagaaccaggtgatttctgacaggcacacctgcgagctttacaggttcctgactcagcctaatcatgatgagagagatggggatgatggtaattatctattcttcgttcctacgagtatgggatgaccagccttgcagtattcggtaccgggcgcattggaggcggagttgctgcccgagccgtatccagtggccttattaatcatcttgttttgtatgattgtaatcaggcactcctcgaggcgcaacgacttgacatcgaacatatgcgatgtccggtgacgacatcgattcgcccggaagacattgtcgcatgtgatatcattctctatgctgccggccttccaagaaaccagaatatcaaaacaagagctgcattgctggattgtaatgtaccggttgcatcagaactagcaacactcattcctgactataaagggataataatcgtcgtaaccaacccggcagacattctgacatattatctctggaagtcccttgggattttgaaaaaccgcatcataggatttggaggccagttggacagcgcacgattccaatatgagctttcacttcgatccatcagagatgacgggataatccttggtgaacatggtgaacatcaggttccaatattcagtaaaaccggacttgatgtagagattcccataagagatgacattttagtaacgcttcggaatgcaagtatggagatcataaaaggaaagggcgcgactgaatatgccccggtatatcacatatggcatcttattgaatcaataattacagatgcaaaaactaaccttatatgctctgccattcttgagggagaatatgatgttaccggttgttctctgggggttcccgtaataatcggaagagagggtattctttcaatagaagagtgggatctcgatctttgggaaaaagaacattttcaggatgcagctacttttgtatcagatctttgcaggaggatagcaattgactcctgattctcagcacatgatatctccgggtgaacaacaatcgccggcagaaaaagatcagaataagaggatattactcagtatatgccaggttgaatactcaaccgcagcagacggacccatcatacatatattcggtcgtactgaaacaggggatttcaaggagatacaggttaccggattttttccatatttatacatcctcgcatcgcaagttactagaaatcatcctgaccaggttatcaagattgatcctaccccatacacatcaatccatggtgaagaactgcgcagactttacacccgaagacccaccgatgtcagagaggtaagagggaattacacccattttgaagcagacatcccttttgctacccgttatcttattgatgcaggaattaccggaggaatatccgtcccggccggtgcatccatcgtcccatataccgatgtaaaaccggcggaagtccatgcaccaaccagatactgccttcttgatatcgaatgtgaagacgataaaggaggtcttccaaaccctgatcgtgatcgcatcatatgcattactgcctgggactcattttccgatcactacacaacatttcttctccagaattctgaaagatcaatcaatgaagagaatctctgcagaaacacgctacataacggatgctttcgtggtgatattcataccatcagagtttttgatgatgaaaagtcgcttctcacaggtttttcctcatacatcagagaaaacaacccggatatcctttccggctggaactttaccgattttgatctcccttttatctttggcagaatccgtgctctgaatctcccccctgacagcatggcccggttacctggcatgagtgagcgttcaggagtcagagggagagtagattttgacctgcttgccggatataagaagatgcagtcatcaaaactggactcatatcgtctggatgctgtcggagagcgtgaagttggtgatgtcaaagcattccattaccagccaggcatgacagcccggatgtggaatgaggctccacatgaactggtcgaatacaacttcaaagatgtagagctctgtgttaaaattaaccagaagaataacattattgagttttaccaggagattgcacgatatgtcggatgtcctcttgaccggacattaaactcctcaaatgtcatagacatctatattctccgtaaagcacatggaaaattcatcctgccatcaaaaggctatagcccgggagatgaattcgaaggtgctacggtttttgaaccaagttcaggtatacgggagaacgtggtggtccttgatctgaaatccctgtatccgatggcgatgatgaccatcaatgcctcgcctgagacaaaagacccgaatggtgatctcatcgcaccaaacggaattaaatttcgttcaaaacctgatggccttacccggagtatcatcagtgagcttttgcaggaacgggatctaaagaagaacaaaaggaatgaatacccctttggctcacaggaataccagctctatgacatgcagcagaatgttatcaaggtcatcatgaatacgtattatggagtgagcgggtattcacgattcaggctctatgatcgggagattggatctgcagttacttcagtgggcagggcgatcatcgaacatacccggaacactatcgaaaatatgggatatagtgtcatatatggcgataccgactcctgcatgatccaaataccggcaacatctcttgaagagacgatcaccaaagccagggagattgaagcggtgttaaatgagagttacaatacctttgcccgggaagttctgcatgcagaaaaacattatttctcaataaaatttgaaaaagtctatcgcaggttcttccagggaggaaagaagaagcgatatgcaggcaatctcatctggaaagaaggaaagtctgttgatgagacagatatggtcggatttgaagcgaaacgatcagattccccgctccttaccagaaaagtcatgaaagaggtcatgaacaagatattgcaaggtgcagacttaccagagattaaaaaataccttggagatatcatcaaaacataccgttccggaggatattcacttgatgagatcggaattcccggaggtcttggcaaagaactgaaagactacgggacggacgatgcgcatgtccggggggctacatattcgaatacttacctgggaaccaactttggcaaggggagcaaaccaaagaggatttatattaaatccgtgaacggtggctatccaaagactgatgtcctctgttttgaatatggcgatcaggttcctgatgcttttgtcccagaccttgaactgatgctggaaaagaccatcaagtcaccaatatcccggattctcgaaccaataggatggagctggtcagacgtggatccaacccggaccaccctttctgattttttttaggaggactatgcagtattaccaggatggagaggagatccggtttaacattccccgtattgttatcgcaggaatccagagcggttgtggaaagacgacaatcacccgtggcctgatggcagcattgaaaaaacgcggacttgttgtacaaccgtataaaatcggacctgactttatcgatcccagtcatcatacccgaatctgtgacagagtttcgagaaatctcgatgtcgtaatggccggggaggacggagtgattgaatctttctactcaggatgtgctggtgcagatatcgcagtcatagaaggggtcatggggatgtatgacggactagactctacattcggaagtactgcgcatatagcaaagctcctcaaagcccccctcctcctggtaatcccggtggatggtatggcacatagtgttcatgccattgcatccggctttcagaattatgaaccggattcaacacttgcaggggtcattctcaacaaggtcggtagtccacgtcatgccgaactgctcaaagccggagcgaagatttcacaatttgggtttgtccccaaggatccttcattccatacccggagccgtcacctgggtcttgttatgggtgatgaaaccacgacagaagaaccagtatccatcattgaggattcctgcaatattcctgagatcatcgcacttgcatcctctgctcccccgcttaccactcaggcgaaagaactggatataacgtccggccaggtaataatcggagttgcccgggatcctgcattttgtttctactatcagcataacctcgaaatgctggaatgttcaggtgcaagactcacatatttcagcccgatgcaagaacatctgcctgatgtggatgctctctatttaggtggaggatacccggaacttcatgcagatcagcttgaaaccggtccggctcgtgaggaaattcgtgttgcctgtgacaacggacttccggtctatggagagtgtggggggctcttgtacctcactgaaggacttgacggagagcgaacatatcgctgggccggagtgcttccagcccaggcggagatggcacagcgatttcaggcattagggtatagcgaaggaaaaacgacaggtggcacatcactcacgccagagggaattgagatacgaggacatgagtttcattactcatttgtcaccccggatagagatgcacaatatgctatcagtctgaccagggggaaaggaatccagaatggacacgatgggatgtatgtgcatgaaactgtcggttgttatacccacagctggttctcaaaacggttttcagatgcgatagtaaaggcagctatggcctggagaaaaagttagagatcaactctgcattacctgtctgaaccgttgcccgaatgaagggaagaaatccttttttctggacataaccccttcaagaatcaccggctgattatgatatccgagttttgttaagagaccataatcacctgcagcaaagaggaaacttctctgaccgatgacatccgtaaccaggacaatgctgatatcatacccgtggctggtctggtactgagtaagagcattctggatattttttgcgttcgaatcagcaaattcacgagatcccgtcataatctgtgcaatcgatacagtccgatcctgaagagtgaaatctttgatatcccggacaatcagatcttcaattggaaatccatcaaggttcattcccttattgatgagctcagtcccaaattcttcagggtcaatatgagcaatctctgagagatacgcaactgcttcccggtcacggtcggtcgttgtggacatcttcaaaacaagagtgtctgagaggataccggcaaggagcatggttgcaatggctttgtccgggactacctgttcttcccggtacctcatggcgattatcgttgaggtcgaccccaccggttcattcctgaacctgatgggctgaagggttgcaatcgttccaagccggtgatgatcaattatctcaatgatctctgcagtctctataccttcaaccgcctgagtatactcattgtgatcaaccaggataaccgatttatgaacgtcttcaagaaaagaattcctggagagcataccaatgaaatgtccatcttcatcagtaacgcaggcagtacgatatggtgagttcgagactatatgagcagcggttgagaggagatcatctttgtgaagagtttctgcatcagttgccatgatggtctcaaccggtccggagagatggagcaatcttcccacactgaacgcatccagagatgttttcagaagagatactcccattttttttgcgctctccctgacgcgttctcccaggtgtgcaccttctgcaatgatgagtgcacaaatcccctctgctacaagcgcaatctgggaaggttcattatcaccaatgatggcaacatcatgagggcctagtctggcaagagagatatgaagcgcatctataacaattgaggcatttccatgtatctcgtcatgtgctgcatgaactatctcggccttgaggattcttgcaagtgcttcaagggtaatgggcccgacttttagtggaaggcttgcatgaggactgacatatgctcgcgccagaccgtgttcacttaccagacctaaaaaccggttttcatcatcaactatcggaatgttcctgatatcataatcatccatgagcaatgcaacatcgattgccggaatattcatgggtgctttttgtgtatacaaaaacggaatatctccgactgatggttcaacattttcaataagaaccgggggctcaactcctgcaatatcgagagcgtattgagtttcagcattcaggtcaccgcatcgtgcagctacatacgtgcctgaatgaatctgattgagcaatgacgcatacgcaacagaactggcaatgctgtccgtatccggttgccgatggccgataatatacgtagggctcataaaatatatgtagagagatgcgtgctaacgttagatatcaattaccgatcctttaaattgccctgaatgaatattccttacaaggcataatcatgaacctgaatgaagagattgatattaccagggccacaggagtcattcagaaacttatcggatatatcggtgccatagcccttttgattggtgggattacgatgtatgttgatcttcccattatcgggagagtgacatgcctctattgcccgacaccatcaggctatctgtatatcgttcttgcgattgtagcaggctttctgatatatgccgaaaaaataaaattcttatacctgaccggcgggcttgcttttcttcttttagcatatgatgcatattctgcaacaacaattggatatgccgttcagatgcttctctccggagggcttgcaccatcaatgggaggacagatggacccggttatgtcccagatgatgcagaataccgaactctctattcctattgcctggattctcatcggccttggagcactgctcatggtcatgtctccccagattgaggcaaaaaaggatgaaaaaacgtccataaatccacgagaagcacaccttcaggaaagaatacaggagctagataaaatagtgaagatgtataaagaaggagatatttcaaagcaggagtttagtcatctgaaagaagagatattgggaactacaaaagagaaatgacatcctgcaccaaattttcttttttttagtaaccttacggtacttcttcacctgaatctaacctggatttatatttggttgctctttccatcagaaagacaggtaagccatttgagtgatcgaatggtaacatatatgcgatcacactcaagcatttcaggtcattctctcattgaacggtatactaaaatttctcctaatttactcgaatcatgaaaaatatcatcatcaaaggtgccagggaacataacctgaagaacatctctgtcactattccccgtgaccagtttatcgtcatcactggattatccggttcaggaaaatcaaccctcgcatttgacaccctctatgctgaaggacaacggcggtatgttgaatcactctcctcatatgcccgccagttcctaggcctcatgaataagccggatgtggaagcaattgaaggattgtcaccggccatatcaattgaacagaaatcaacctcgaaaaatccccggtcaacggtcggaacggtaaccgagatctatgactatctgcggttactctacgcacggattggtatcccctattgtcctgaacataaccttcccatcatgggacagtcacctgagcgtatagccgaacggattgaagaggaatgcaccgggcagataaccatccttgcaccccttatcaggaaaaaaaaggggacataccagcagctcttcaaggatctgaataaggaaggatttgcacgggtcagggtgaatggagagatataccggacggatgatgagatcaccctggaacggtacaagatgcatgacatcgatctcgttatcgaccggctcgatgtatcagatcactcacggcttgttgaggcatgtgaacaggcatctgccagatccgagggacttatcatcatcacctgtgaagacggggaagatcggacgtattcatctaaaatggcctgtccgatctgtggcatcacctttgaagaactccagccacgaatgttctcctttaacagcccatttggtgcctgtccggactgtaaggggcttgggatcagaatggactttgatcctgatctcattatccctgaaaaagaaaaatccatagccgaaggtgcaatcgcaacctaccggaatttccttgatggataccggtcccaatttgtcggagccgttgcaaaacattttggctttacggtcaataccccgattaaagatctgaacgaaaaacaatacaatgctctgatgtacggttccaatgaaaagatctcgtttcatatgagttacaaacagggtgaaggagagtggtcgcataagggaacctgggaagggctgctcccccaggcagaacgtctgtacagtcagaccaattcagaataccggaaacgtgaacttgaaaagttcatgaaaattactccctgtcagacgtgcaagggaaaaagactgaaggataaaattctcgcggtcagaataaaagacaaatccatcatcgacctgaccgatctctctattactgcaagtattgcattcttcaacaacctggaactgtcagagaaagagacagaaattgccaggcagatactgaaagagatactttccagacttaccttcctcgaacgggttggtcttggatacctgactctttcacgaagtgcaggcacactctctggtggtgaagcacagcggatacgtcttgctacccagattggtgccaacctcatgggggtgctctatgtgcttgatgaaccatccatcggactgcatcaacgggataataaccggctcatcgacaccctcaggcaactccgcgatcttggaaacactctgattgtagtcgaacatgatgaagataccatacgggcggcagactgggttatcgatatggggcccggtgccggccttaatggtggtgagatcatcgccgaagggacaccccacgagatcgaacagaatgagcggtcacttaccggtgcgtacctctccggacggatgcagatcgaaatcccggagaagaggaggattcatgatcggtatatatccatcaccgggtgtcaggaaaataacctgaagaacatcaccgcccgaataccaatgggtaccttaaccctcatcaccggtgtatccggatcagggaaatcatctctcatttatgacacgctctatccggccctgcaaaagatggtctatcattccagagttgaagcaggaaaacatacatctgtcacctgtgatgaacccatcgacaaggttattgtcatcgaccagtcacccatcgggagaactccccggtcaaacccggccacctatacgaaggtcttcgatgagattcggaatatctttgcagagacaaaagaagcaaagatgaggggatacaaatccggacgattctcatttaatgtcaagggaggcaggtgtgaggcatgtcagggagacggcctcataaaaattgagatgaactttcttcctgatgtctatattgaatgtgaagagtgtaaagggaccaggtataaccgggagacccttgaggtcaaatataaagacaaatccattgccgacgtcctggcgatgagtgtggatgaggcaatcgaactcttctcagccatcccgaagatcagaaataaattgcagactcttattgacgtaggactgggatacatcaagcttggacagagtgctacaaccctctccggtggtgaggcgcagcgtatcaaacttaccagggagctttcaaaacgggcaaccgggcagacggtctatcttcttgacgaaccgacaaccggcctgcatttccatgatgtcagaaaactcatccaggtcttttcagaactggttgcaaaaggaaacacggtaattgtaatcgaacataacctcgatgttatcaaatctgcagattatatcatcgatcttggtcctgaagggggagatgccggtggagagatcatcgcaaccgggacacctgaagaggtagcaggcaacccagccagttataccggcatgttccttgccaaactcctcccttcatcacctccagataagaagaaacgaaccccacgtaaaaaatctgagcagacaagtggatgatatggtgagtattgatcttaccaccatccctgaagaaccgggatgttaccaatttaaagatgagacagggactatcctgtacgtcgggaaagcgaagaacctgaagaaacgggtatcaagttattttcagaaaaaaagtattacgccccgtattgatattcttgtctctctcatcagggacatcgatgttatcgtcacctcatctgaagtcgaagcactcattcttgaaaacaatctgataaaaaaataccagccgaaatacaacatcgacctgaaagatgcgaaaagttacgcatttatccagatatcaaatgatccttttccccgaatcggtattgccagggacagaacagttaagaaaaccgggacgttatacggaccatttgtctctgccgcagaacgcgatcagattctgaaatttgtcaagcagacatttcacctccggacctgtaaaaagatgacaaagcgggcatgtctccgttctcaccttggaacctgtgctgccccatgtaccggaaaaatatcagaacctgaatatcaatacctggtgaagagtgcagattatctcctgaaaggaaagagccaggatctcatctatgatctccggaaagaaatggaaacttttgcagctgcagaagagtatgaaaaagcgcttgttatcagagaccggattgctgcgattgagaatctttcagaacgacagtatgttcaacggcagaaaaaatctgatgaacatatcatcaattacctcgtatccggagataccgtatacctcatcctctttcatgttgaacgcggatcactgaccagtaaagaagagtttgttttcccggaaacagaagatttccttgatgaatttattctccagtattactcatcaacaaaaccacccaacgaactgatactcccctcacttcccggatcagggatggaggaatatctgacacacatcaggggaagccatgttactcttactatcccgaaacagggggaaaaaaaacatcttctggatcttgcctataaaaacctggaagtctccttcttcaccgggaagatgagacttgcagaactgggcgaagcgttgcacatggatacagctccggaggtcattgaatgttttgacatctcccatctccggggtaccggaacggttgcatccatggtctcattcagggatggaaaaccggataaaagaaattatcgacgatataaaataaatagtgctggtccttctgatgattatgctgccatggctgaagtggtgaagcggcgatactcccggctccttcgtgagaagagcccgatgcctgatctcattgttgtagacgggggaccgggacaattaaaatctgcacatgccatccttgaagaactctcccttcccatacccatcatatccatagcaaaacgtgaagaggagatctatattccaggaagaaatactcccctttcgatacaaaagaaaagccctgcatcactcctcatccaggagatcagggatgaggcacaccggtttgcgattacctaccagaaaaaactcagacaaaagagtataaaggaatgacagaatttcaactggtttcaaattttaaacctaccggttcccaaccggatgccatcagacagctggtagaaggttttaaatctggatcctcatttcagaccttacttggagtaaccgggtctgggaagacattcacgatggcaaatgtcatcgaacaactccaaatccctacccttgtcatcgctcataataaaacactggcagcccagttgtaccacgaatttcgggatttttttccgaataaccgtgtagaatattttgtttcctactatgattattaccagcctgagtcatacatacccaagaaagaccagtatattgagaaggatgcccagataaatccaaagatagagatgatgcggctctcagcgactgcatctcttctgagccggaatgatgtgattgttatcgcatcagtatcctgtatctacggtcttgggcggccagatacctataaacgaatgggttttgatcttggtgtaggccagaaaattagcaggcgggagattatcagccgcctcgttgacaatctgtacgaacgaaatgagatagagatcatcccgggaaggttcagagtaaaaggggacattatcgaccttgtccccagttattacaataacatcatcaggattgaactctttggagacgaagtagaacgaatcaccgaaataaacagaaccaccggaaacccggtcgagcgattgagacatgtctatgtctatcctgccagtcactatgtcattgatgaatcgcaaaaggagaaggcacttcttgagatagaaaaggaattgaatgagagacttccccatctggggatgcttgaatcacaccggctccgtcagcggaccatgtatgatatcgagatgatccgtgagacaggatcatgcaaaggaattgaaaattattctcgtttctttgacgggagaaaacccggagagaaaccatattgtcttttggattatttcccggaacggtttttaatattcattgatgagagtcaccagacacttccccaggtcagggccatgtttcacggtgatcggtcaagaaagactcctcttgtagagtatggattcaggctcccatctgcatttgataaccggccacttaggtttttcgagtttgaacaatacctgaagaatgtcatctgtgtatctgcaacgcctggtgattatgaacttgatcattcaacacaggtagtcgaacagattatcaggccaaccggactggttgatccggttgtagaagtcagaccaattcagggacagatggagaatattaaattcgagatccaaaggactatcgaacgaggagatcgtatcctgataacaaccctgacaaagcggcttgcagaggaactaaccgaatatctcctgtcacatggagtaaagacccggtatctccattctgatattgataccctggaacgaacagagatcatacgagaactcaggctcggcagctttgatgttctggtcggaattaatctacttcgtgaggggcttgatattccagaagtcggatttatcggaattcttgatgctgacaaggaagggtttttacgagatgcgcgtagtctcatccagattatcgggcgtgcggcacgaaactccgatgcttttgttgtcctgtatgccgatacggttaccggatccatgcaaaaggcaatagatgagactgagcggagacgggcacttcagattgaatataatacatctcatggaataaccccgaagaccattcaaaagccggttcgtgatcaggagattgatctcggaaagaagaagaaggttccaaaatcagccctgccaaatctcataatcaatctggagtcgcagatgagatctgcagcccagagacttgattttgaagaagcaatacgactgagggaccaattaactgctcttagaaaagaaatggaatagggacgataaaaaaattactggacggtaataaatccgtcttttgtttttaccgaacttccttcatcactaaagacactcaggctcacggtgtaatttccagattctgagtatatatggaccgggttctgatcatatgacttaactgagtcaccaaagtcccagagccatgaggtcgggaatcccagtgagcgatcctcgaactggaccgtgagaggtggttttcctgaaaccggatgagcgataaagtcagcctctggtttttgcaatatagttatggtctcatatgcatagtccttagcgataaacggtttttcaacctggtgagttacctgataaacacccggtgcgttgtatacatgggttgcattcttagaaatcgctcctttcggaccatctccaaagatccatccatacgctactccattggtattcaatgaggtatcgataaactcgatctcaacacccggtggtacgatacctcccttggattttgctgtaaatccggctatcgggtttgtagtgacctcgatgtaatgctctttcgtcttattcactccatccttggcagcggcattgtaagcggtcagcgtaacggtgtaattgccaacctctgcgaaataatgcacaggttcacgtgtggtggtaatttcaccatcgccaaagtcccagagccagtctgttggattatttctggtaaagtccttgaaagttacgggatactttggaggaacacgggtccggtcagcttcaaagtcaggttcaggtggaatgacaaatactgcctctatcgtgtgattatcagtaatgttagtaaagcagtactgatcatacactccgactgaactgttgtcaacaatcacatcatagacaacatttccttcatcaggtgtgatgttaaagcactgagtgctgccacaattgaccgtaacaattccatcatcaccggcaggatcaatcactccgccttcactctgattcaccagaatctcataggtttttatttggaaatctgcatgaatggtatgatcctcagtcacattttcaaaggtataggtagaaattgcaccctgactctcaccatctaccaaaacatccttgatggtgtaacatccgttcggagtaatggtgaaggtagctgaatcgccaattggaaccacctgcggagtggatggatcaatagtgccccctacccctgcagacggtgtgatggtatatgcatactgtgtaaagtatgcagagatgttgtggtccttggttacattgttaaagcagtactgatagggactggtctggtttccggtatcctccccgtctattactactgatgagatatagtagttcgtatgtgcggtgatgttgaagcactggctatcgccaaaggtgacattcacgatgccttcaggctcaattataccgccctcaccagcgaccgcctcgatggtcaggacgtcagactgaaaatgtgcaacaatatcgtgatcctctgtgacagttatattgtacgggttcaccgctccttttgaaattccattatcagtgatatctgataattgatatcctgcaaacggattggaagtaaaagaaagttcctctccatatccggcagtgtaattagacagggcaggaacaattattccttttgtctcatcttcagatcgcgagttcacactgtagttcaatggttcaaagtgtgctgtaatggtagtgtttttgtcaatgtcacagaccgaaccgatataaatcttgtctgattcagacgagaggatctcttctgcatcggtagaagtaaagtttgcatgagtaaaccgataccccggatctgcaactacttcatgctgatgtgaacatccaaggtattctatccagtatggtgttgcctctgatgctccatcaagaatactacccccggttgttgcaaccggtgtaataaggacgtgggtaggtctgaagagaccaagcagagtatggttatggatcatctgtgatgcagggaaatcccatttatcattgtattttttctccccgtcgacccagagttctttaaacacatagccctcatctgcagtgaaattatactggtaacttggagtttcaaattcatacagagtaatgcccggatagtttacggatcctccttttcctgcagttgcatttaccgcaactttcttcttttcagatgtaacggtaagcgttgcattctctaacactttggaatgcagatactctacctcatactgactgtatggataggtgatcgggtcatagccatctcttacgaccgtaagatttccaaccagccatgccggcttttctccagtcagattaaatggctgagtatttcctgcttttaccgcaataacaccagagggagtgattgtactatgagcatcagctgttgcagtaagatagtatgtcatcagctcaagctgaatgatatctccccattttgaaggtctgccttcaaacagagttgtatcaacagtaacattctttgctgcatacagaggcatctgatcaaaggaaacattcacgatctgctgtgacgggaggtatacccagcatggagtggtgttaaccagttcaccatcgacacgaacatttgctcccccctcatcatccacgtttgtctcaaagtatacctgaacaaattcctggtctgggattaacgtctccactacggtttttttctcgcctaccgagatattgaagaaaccaacctcctctttcatggagtacccatcaaggaagtatttatacagatattcaccctcatgaagctccatttcaaatggagtggttcccacaagacctgcaacaaattttattggcggaatggtctctgccccgaccatactcttgatttgtacagaagcctcatcagcagtcccttcatatgattcaagatattcctcgatctcggtttcaagacctgcttccatatcagagaaattaccgccggcaataatgacccttgcactgttaggctcactcttaaacgttacaattccagagtctggaatcggtacgagagggacataaatttcagtcacatcaccagctgtgacttcagttgtattcgaatatggatagtacccatcctttgtcaccgtataattataagttccaggtggaagagactcaaccgatgccggtgtggaactgtatatcacactggtaacatttggaataaaccgctgaagaacaagatttgcccctggtggatgggtgtcaatatgtattgccccgtattgtggattggtttcagtaagtgttacattgaaatcctgataggatcccggagtaacagtgaatgattcattccaccaggtaatatacccatatttcttcagaaacagccggtaggtccctgggtcaacaaaaaactcccgcggtgtaataccagcagtatcgtgaactgtcagattatcaggcgatactgaagtattggtgagataaatctcagccccatccggatgagaatcaacatagataaccccctttgatggagcggccatagatccggtcacgagaagcatgaatatacatgccactgcaatgaacggaattatctgaacctttcccataatttgatcgtccccttcccttccatacgtgaatgccctgtttttttaaaacgcattccccatacgggtgcacctcgcaacaggaattaatcagggttatattgttcatcatatatataggtatggaaatacgtcctatatacattcaatttttcattcgcctcgggaataaaaactcatttctcaattgaaaaaatattaccgacgaagtataaaaaaacagatttattaaattattttaaaaaagatagagtttggacgattataaaacgacgacgtatgcaacacgacgtttctcattcgttccattttcattgcgcacggtgagagtgactgtatattgtccgggtttctcgtaccggtgagttggtgcctgctcaaatgagttcgtgccatctccgaattcccagaaccattcgataacatttgactgggccggagtcttgtcttcaaactgaacgtcaaatggagctttgccactgtattgtaattcaggaacttcgaaatcaacaccctgcgggacggttttattaacgatggtaatctgttgtgaggtcgatgcagttactggttgccagttagtcacagtgagatttaccgtaaaagttccaatatcctgatatgtatgagttgtcatattcgtcggtaaattttcaagtgtaccatcaccaaagttccaatgccattgtacgggactgccttttgaagtgtcaataaaagtgactggagtattaacaactgcccatccggatggaatagagatgaaactgggtatcaaccctctgacactaatataatcagtttttacagcagtatcttctccaaatggatttgttacttttaaagacacagtgtattttcctggtaactgatactgatgagatggatttgtgccattcgaagtctgaccatcaccaaagtcccagaaatatgacgaaatgtcaggtccctgaacatgagaggtaaagtaaacataatcctgtgtattaaccgttgttggatcagcacagaaatctgccaccggtgcccgcatctcagtaacatttagcgtatagttaacactttgaatatcttcatagtaccagttgtaaaccgtgaggttcaccaggtactctttaaattcagggaaaatatttacaggattctgctgatcagaggtgttcccatcaccaaagtcccagaaccaatcagacacattacccatagaaagatcagtaaattggacaccctcataaatattcattctagcagtcctgtttggcataaagtcagggtaaattggttctacaacctcaatagtgttttctgctgaacctcttgccccagttgttgtattccagactgtaaggttaattgtataattattagccccataaaaggtgtgaataggatttttctgagtacttacgggtgtattatcaccaaagttccatgaccagttcgtaatccaggctgaaggttgtgataaatcagtgaattgaactgtgaacggagacactcccctggatttgtttgtactaaaagaaacattaaacccttcagatagtataatgttctttgttagagtattcgtccagattggatacactgtagtgtttcttacaacctgagtaattagatatgttccaggattgttaaaggtatgaacagggtttttatcagtcactgttgatgatccatcaccaaaattccattcatactggtcaggagaatcggtcgtaagatcggtaaattggacttgtaatgggaaggttccatattttggtgaataatcaaaatttgcaattggtctttcaattattgtaataattttttgtgttgaattatattgattacaactattccctacggtaaaattaaccgtataattaccaggactattgtaggttgtctttgcatttggctggattgaactgccaccattaccaaagtcccagtggtaatacgttgcaccaaatacatcggttgaatttgatgtgaaatttactggaattgattcaccggttgtgttttggtaccccactagtttatcagatgtgaaatttgcatataacccagttacatgaatttgttttcgttctgattgatttatatcatgagttgtgttgagcgtagttagagtcacattatacaaacccggcaaattgaaaatatgagttgcatcacgtgttgtaatatttgatgacccatcgtcaaaactccaattatatcgatccggattactgtaacctacctgggtcgcatttgtggtgaatgaatatgttactggaaatacgggctgtaaacatgtagttattggatttgaagagaaatttgcagatattggaagatatgcattaacataatttgtccgggttgtcagattagatgaccaatttccacttacatttaatgaaaccggatacaggccaggggtgtaataggtatgaattggatgttctgttgtactcgtatttccatcaccaaaagtccaattaaagtgtagagtatcacgataatcagatgttgaattattaaagaattgtaaacataatggaacctgaccttttgcctgttcggtaaatgaacttatattcgtcgtgaaaattgtcgaaatatcatctctactatcgatataaatcgaacgcgaaatcgaactgtttacacgtaatccaccatccgggtaaaagggagaatcatatgacctgttccagaccgtataattaattacttttgtcccatttgttgaataacacgtagttgcaggattgattgtttgattccctaaaccgtcatttaattgccatgcacgatctgttggccccccagtcgagttatctgtaaaggtgacacatagaggtagaacgcctgtggtagatgtattcgtgaaattagctgatacaggtaaataggccgttacaaacccaaaggttttattgacaggattaaatgcctgaggatttgaattgttatatgcattgcattttagatcatattgtcctacattagtaaaattgcagacaatccaattaataggtgaagttgttatgacttccaaaaaattagtagtagcatacctctctttaatactccactgataccaatcagcaatatgagaagattcaggtgaaataatcgctgtataattaacacttacagggggatttgacacatcaataaaagatgcattcgctgaaacatcaaaggtcactatcccttcaacattaacttctccatccccaaaaaccgggctcaccaggtttaccatcaataatgccacaaacagggcaaatacatagtataacggtcgttcatgcatgacttataacactccccacgtggatgccagtccctttgagttttcagatcaacacctgacgtcatttcagacctgaaactcagtaaccagaaccagctcttgatatatagaagatcatattcttcagatattataaatatattcatattttttcggttcatccctctccttacccctaattgatcatataaaacaaaccacaaaccacctgaagcagggaagtaattttcaacaaaaacattccatatgtaccgtatggcagagccagtacgggtgaaaatgacaacatccatgggagatattctcatcgaactctatgaagataaacccattaccgcaggaaatttcaaaaaactcgtcgaaaaaggattttatgatgggatcatctttcaccgtgtgattgacggattcatgatccaggcaggatgtccagaagggaaaggaaccggaggccctggctacactatcaaagatgagtttgggaagaacaaccggaatgatcgcggcaccctctctatggcaaactgtggcccgaacaccggcggcagtcagttcttcattaatgttgtcaacaataactaccttgatccaaaacacccggtattcggaaaggtaattgaaggcatggacattgttgatgcaatatcaaaagtaaaaagagacaggtttgacagaccaaaagaagatgttgtcatcctgaaagcagttattgtctgaaaatcagtcttcagactcattttttgagtttttatatctctcgatatacctgatctcttcaataccctcgatctcatcaaagattgagttcgttatatagggtttcatattcagccaggtcctgctcgcatagtaaataccagggggcagcttgatgagtgcagttttatcctcaagactgacttccatgtcatatcctgaaaagagcttgataagtccggcgatcttttccgtcgcgctttcaacaatcccttcgattcgatatgtgtacgtcagggtttgcccggcaagtggatggttaaaatcaacgataacccgatttccaatgacatttacaaccgtaccggttccagtatcagggatagttacccgcattccccgttcaggtttggttttaaaaaccttcttttcatatgaacggaggagctcctgttcatgctcaccaaaccccttttccggaggaacctcaagtgtctcttcaaaaccaacctcttttccgatgatagcttcatctaatcccagaatgatctgacgttttcctgcacacacaacctttggagtatagtcccgcccttcttcaaagactccggcctcacgggctttctgttcctcggttgtgtcaaagagaataccatttgcatatccggtaaagttcaaccggataaagtcgccttcttgtattgacattcctgattccttaagtaagtggcaaacaagatagataaaggatagtgtatatgcttgagattgaaataaaagtcaaagtccctcatattgacgagataaaaaaacgtattcttactatcgggggaaaacattcagaaaccgtagttgaagaagacctctattacaatgccccccaccgtgattttgcacagaccgatgaggcccttcgggtacgaagtgccggcggtaaaaccatcctgacatataaaggtccgaaaaacacgttgatgggatcgaagataagagaagaatgtaatgtccagctcgataatgcaggagcttttgatacaatacttaaaaatctcggattcaaaccagtagctcatgtacgtaaattgcgtgaatattatacctatcaggatttttcaatagccctggacaacgtggatcacctgggcgaatttgtggaaattgaactgataactgaaaataatgcagagaaagctgcaaaaagagtagatgaactggcagaaactttaggagtggttggagaacgtatcagcatctcctaccttgaactccttctttctacacagtaagtaatttcacttcaatgtcttttgcttcttcaccaaagtgtatcatggcacagttgcccatggcagccggaccaggattgaccactttaatgccaccttcttcaacaatcccacgctgctcgtggacatgggcacagcagataagatcaaaccgatccatgtatttcagaacagtcgcacttccaacatggtttccaccgatctcatccaggaatccctgtgggggagcatggctcagcaggacattatgaatactcttctgcatccgctccattgataccttcatcagatcatcgatctgcttatcggtcatttcaaacggagttccaaatggcgtggggttggatccaccaatcccaaccagagatatccggcccaggttcatacatgaaccatggaggttgacactgttactctgttcaagagcatcaataacctctttaggatcacaatttccgggaaccgaaaaactcgggacatcgatccgggaaaaacaggtctcaacatcctttgcagttcccatattggtgatatcccctgcgatgaagacaacatcgggcgccagttccatgaaggattcaagcatcccgtattctccgtgcagatctgcaagcaggagcgctttcaacatacgttattacttggaaattttgctaaaaaatcttatctcaggattgttccatgatccagtcaatctcccagataatgccagtgatccaagagcggatacaacctccgggatcagatcacgggatacacggccttcaagaggcgttcccggaagggaaaaaaagcgatgggcatgaacatacccgatctttgagacctcccggcagaatgaaacggtggcaagcagttcttcgtcagtttcatcaggaaaacccacaataatatcgacaaccggagtaaaacctgcatcagtagtgtgatcgatagccctccagacatcagacagggtatgtcccctgcgaatccttttgagagtactctctgcacccgactgggcaccaatatgaatccgggtatttgaacaatacctggcaatcagatccactgcctcttccgaaacaaactcaggccttatctcaccgggaaatgttccaaggaagatatctttgtcaggtatctttgcaagctcatgtagtaaggatctgatatgccggggatcaggatgaagaccatcagtaccatatgcaagcgcattcggacttaaaaacctgatatcatggaatgagtgcgcaagccgaacgatagacccaatactccggtggcgtatggtatttccaaaaatccggggagtctggcaataggtgcagccatacggacagccacgggaaatttcaatatatcctttatattcactaaaacttgggtttccatcgaggaaaaccgtgtgatcaacaggctggaaagatgaagcagtcgcaactccgggtggtaccggggttccggactcaatgctttgtaataatcgtggtacggtatactcgccctctcctactaccacataatcggcgatgtgaactagttcatcccaacgtgcacatgcatggggaccgccgattacagtaatagtatcggcagcgtttatttcaggtataagagagggaccggtgatggagttcaaactatacagcgttacatccttttcaggaccgcacgaaaaatcaagcgtgtatcctgcccgctcacaggcagcatacaaacacgccatgctgttccgctgacttggaatcgttctccagcagacacgcatgatcaaaacacagtagcttcagtatacaccgtcacagaatcctggtggatttcaaatggtttaacctctcgtgaatgctgtgacatacgcatcttgacaacttcaatcgctagatgcacgtcatttacatcttcacctcgagcatattttaaaagaatgaccgtgtcactcagatattcaataagattatatttactggcaaatgtgttggttttgtctgcctcactgataagcagtgatgtgcagttcagatcacgaagactctctaaaaaccgcatcatttcccgtcttcgtgttgcatcatcatgaaagagatcctcaaagagggagaccggatcgataaccacccggtgtgcacctgtctttttaatcaatgttggtagttcgtttttcacgctatttatcgcaagattgaaatccgatggatcaagatttacgatggtaaatgtggaatccaaatattgagagacatcccatcccttattttccatatatccaagaattctggaggttctttcttcaagggtgatatataatgcactctgaccctgtatcagaccctgccaaatataatactgtgcaaaattggtttttccagtaccatatgctccaataattgaggaaacagtcccttcaatgagaccgccggagagcatctcatcaagtcccttaattccaaacccgaaccgtggaatactcattaacggaattctcatataaccaccctgatgttactgacttcgaatccgcgttcaggagtgatctttacggcaaatttcacaagatcacgatcctcaagatggatcatcacccccctgaatttctctatatataaaacacgctgacgctttgcgctcgatgattcttcccatttgaaatgaattactgcatccatggcatcagcaacctcaatctcctggtacggactgagtatgcctttcgtcagaatcagataaaaggaggtattccattttttggcaacacgctgcattcctctgaggtatgcggagaggtcaggccattttcctgctgcaatatactgggttgcaatctccgttaatgaatcaattattaccagactctgattgggaacatcgtcaagagtaaaggaaagggtggtcagaaggttgtcatggatcttccggcgcgctgtcattcgttcaataatatcatcatactcggaataccaagtgataggaacaagactggtgtcaaaatagatatcggataaatcttcaaagtgaatcctatcaatgtgagataagaaatcttcatgaaatgattgtgaaatttcacgcaatattgattcttttctctttgttacggtgatataacaaatatctttgggaattagcactttctcatccgttgattcacggttcatcaggtgagagaggtgtatcattgaactatatgcaaactctatctttcctgaaccgatatccccttttaaaagtaccacagagccaggaggaatacctccatcaaaaaccggatcaagggttgataatccggttggcatatgttgttcgaattttatccctgtcattatacgaagatccgggtacctgtatttcatccgcaataacaaattaagtctttggattgaatgataaggtcacaccagggagacaagagaatatacctttctcttggaattgatggatcaaaaccttgtctcattcctatcggttgtattatttttatgctttgatgtcatatgatattttaactggtgccggggggaaccataacggagagtaataatttctggtgggtaacagatgggggaatcagatacacaaaataaaaagggacagcgggaaaataaccgtcgctctataaaaataaaagtaccgaatattagtatcggcaaaagcagcactccccccacccatacagagaagccaaaaaaaatcattaagaaaccagaaataaaaggacttggaataaaaaaagtcccccatatcgacctgataaaagagcaacctcaaaaagagatcgagcagccttctggaataacccggataaaattaccattattaaaacgggaagaagagatcgttgctgttgaaaaagatctggaagggacatttactaccgtaaaggagagtccggataagaattttgatagaaaactcctgaaaaaattaagtctgactcataaaaaaggattcgaggagtatgattttgataaacacggcagccttcttgatataaaattacagtatccctatgaagcaaggcaggaatactgggtggagcctggcctcgctaaggtggttattgcacataatgttcgatccaagctgagagagtatcttttatttgaacccgaacttaccccctttgaatatgaacttcttgaacgaatccatgaggatctcagagatgtactcattctcaccgatgaggaactgggaattgaacgaaagaaacttcttatctcaaaagttgtcgatctgatcgaatattacgggttgaaaatagaacagaattcactatttaaaattgaatattatcttcttcgtaactacctgggttggggccgtattaatgcccttatgatcgatcccctgattgaagatatctcttgtgacggggataatataccgatctttctgttccacagaaaagagcagaatattaaaaccaacatctcatttgataccaattcattaatatctctcgctattacccttgcccagcgatcaggaaaacatatctcatccgcgaatccgatcatcgatgcgacgatgccggacggttcacgtcttcagcttaccttcgggacagaagtaacatcccgtgggacatcatttacgatacggaaattccgtgaaacacccttcaccccggttgacctcatggatcttcatacgttcaatattgatatgctggtgtacttctggctttcaattgagaacaacatgagtctggtatttataggcggaaccgcatctgggaaaacgacatcacttaatgccgtttctctttttatacccccgcttgccaaggtcatctctattgaagataccagagaagtaactctgtttcatgataactggatcgccagtgtgacaagggagattgttgccgaaggtggtggagcccatgttgacatgttcatgctcctgaaggctgcaatgcgtcagcggcctgagtatatcctggtcggtgaagtcagaggtcatgaagcccagacgttattccaggcgatgaacaccggacataccactttttctactatgcatgcaggaagtgttgatgcagcaatacatcgtctggaaaacgaacctctgaatgttccacgaaacatgcttcaggcacttaatatcatgagtattcagaaacagatccagatcggtcctgaccgggttcgccggtgtgatgagatcgtggagattgccggcattgatcccgccaccggaaatatcatggtcaataccgtatttgagtacgatccagtcgccgatgattttacctataccggcagatcacaggttctgggtgatattgcagcatttcatggatgggggcctgataaacttattgaagagatgaaccgaagaaaaatggtcctgcaatcggtaaaagatcaaaatatcagggactatgtcagttttacgaaggttatccaggcgtactacattgataaacaaaatgttatagaacatctcgatgatcttgcatcgctggtagcatgattcctgcatgggttgtaaaccggctggtatacaaaaatccggagaaatatcatgatttgcatatcgatttaattggtatcaggtccggacttacccttgaacagttcttaaacagggctgtactcgtaggaataggaacaggtatttttttaggacttctgggttttattacaggcttcgcattattttctctggatcttggattaaagcctgaattatataatgtcctgaacatttcatatgatcctgataccggagacctcccaatcattattatcgttcagattttgcttggagtcatcctgttcctcatcggtagttttatcggctattgggcatacaccgtgttaccttccctgacaaagaaatcacgggagacaaaaattactattggccttcccaatgccgtctcgtacatgtatgcgatgagaaagggaggcgcagaaataattaccatattgcgctccctctcagagatgtctgccatatatggggaagtatctttggagttcagacaggcagtcagagatgctgatttcttcggttatgatatcattaatgccttaaagcatgtaagtgaaaccaccccgagcagaaaactcagggattttttgcaggatcttatctctacggttgagagtggaggaaatcttgctcagttccttcaggaccgggtttttattcttcaggaagaagcgaagtttgaacagaaacagtttctccagttcctggggctcgtggccgagatatatgttaccatattcattgccggaccactctttctcatcgtaattcttgtagtcatggggatgatgggatcatcagctatccttgaattatcacttatcgggtatgccgtacttcccatcggagctgccatttttatactgatgattgataccatatcaataaaagatgagaatgttgtcagatatgtgagtgcgaaatggctgaatcagtactctgatgtcaggatttccgagggaggaaatgaagaacatctctttgccgccctggcacggtttgaaaagataaaacctttaaaaagatggttggcaaacccggtccagggatttgttcagcatccggaactatcattttattttagtatccccatagctctggcctatgttatctatatctttctaaccattccggtcgggacacttgaggacaacatcaattatattgatgatcaactgatgattgcccttttgataactctcattccgtttgcaattttttataccagatggaaccagaagatccgatctcttgagtcgatgattccggattttcttgacaggatggcagggattaatgaagtcgggattacccttacccagtcaattgcggttattgcacgggcaaatatgggagttctcgggtatgagatcagccggatacaccgtgatattgagtggggggcaaatttttcagatgcactaatccggtttgaacaccgggtgagaacggcattgattgcacgtaccgtcacccttattacccgggcagcaaccatgagcagctcaatatcctcactccttcgtattgcagcaaatgatgcacgtatgtcagaaaatctgaggcgtgatcgtttctcggagatgtttatctataccgcaattgtgtatctgtcattctttgttttcatctttgttatcggagtaattactacccagtttctcaccgtccttgcagaacagagtaaggaggggcttgccatggcagggccgctatcaaaccttggatcaacatcacttattaccatggatcgtctgctctatcacatatgtttgatccagggactgtgctcagggctgatggcaggactgatgggagaatcctcaataaaggcaggcgtgaaacatagttgcatccttatcatcggagcacttgcagcctttaatttcatgttctaaaaaaccggacatctggtttttattgagccgttgttgatgaaactcctgaacgacgccattccctgaatcgaagccttgtatcccagataagttcccgtaaacctgtttcagaactttcaaggaggtctgataagggctttgtagcccggggatcattgagttcatacaataatactgctacccatgcccgtctgctctgcgggccctggtagaggagtggtatgagcatatcggttacctgtggaccgaatcggagaatagaagctgctgcatccatggcatgcaggggatcatcaagattcatgagaaacccggatatatctgaccggttaggagcaggagttttatctaaagatccgggttttattcccttttcttcagcagcttctgtctcatgaggacatccgatatctgtaaggagttgtgacagacgggtattttcagtatcaaggcggatgatcctggaagccaatactgagttttcagactccttagcagcaagtttaccggaaagattctgaatctgacggtataatgcgtgaaccggttcttctttctcctcccgaatggtcttttcaagcataaggaggcgggccctgacacgttctagttctgcacgaagagcctcattatttccactgataagagagatatgccgatccctctccgctatctcccgtgcaccagactcaagttttgccttccactcttccttccttcgtatcagttcctcgtgaagataggtgatctcatccctgaactcctgttctctctgggctttcagatgaattgtttcttccagatcatgtgcgatctcctctatacgggcggtaagcttatgtgcttcatccttatgtgatacttcacttgtcacaagttgatcctgaaggtcttttatttgaatactgaatgattgaatggactccgcataggatttttcatctgcacgatgctggtcttcaagtctttgtatctccagattcagttccgatatacggctctctgccgatttcagctcctgatccttcatttcgatttccatagtaagctgataaatagtctgttccatttcagcggccttaagatcaaaggaactggataactcgcttattctcttatctttcaaagcaccgtcattctgaagttcatttgaaagacgaacgagatctgaattttctcttgtcagttgttctattgtttctgcatcacgtgctgatttttcatgcagggatttaatttctctctcgagatctctgattttgagtgaaagatcagcttcaagatctgtttttccctgtatgagttgttctatttcctgggtaagatcctgaacttttctggtcaattgtttagtttcttcgttgaacaacgactgaagatgagtataatccgaacgggccgattcaagaaaagactgtagctctgatatcctcttcgtatactccccctgttccctgatccggtctttctgtactcttttctcctctgcaatccggtttttcaggtcactggcaagggtcctgagctcatgttcttttctgacaacctcgtctctggttttggcaaggatttcttcatattccgaacgaagatctgatttttctttttcgaataaaaccttttgagattccagctgatcagtcaattgcttaatgcgtgcagaaaaatcctctatcttttgagaggctgtattctcgtgttctttcaccagatcggtgagtatttgtatttgggcttctttttcctgaattgatgagagatattcggagagagacttttcaagttcagatattcgggtcagatagtttgcctcaagttcctttttctctttttcaaaagactcgtgctcccggttcttttcacggcagagagtctcatattttttttcagattttgatgatatatcctgggcctttttcaggttcttattcaaatcggcaattttgtcttcaaactgcttgataatcacgtcagactcatgctcaagtcggctgattatacctaataattcctcatttttcttttgaagtgtcaccagctcattcagaatagactccgctaaatccatacagccccccacaagcccatggaaaattcctgtttataattagtatataagagaggtgataaaatgatctcatctattgtgtgaaacactcatgactcttggacttacagtagaaaaaagaaaaaatccacaaaaaatataaaatatatatgcgcgagggatcagagagtaaatcgtgccatggatgcagatatctgttcggcaatacctgcaacctgatcaatgattacccgtaattgttcgactgatgcagacgattcacttgtcgctgttgctgaatcaacagcctcctttgcagtatctttcagcatggcagatacttcatgcatactactggtgatctcttcaacagctgcagcctgctcttcattcatacttgcaacctgctcaatattcattgatatctcctcaaccgaattggccagtttcccaaaaattgccagggtatcggatagaagtacatttccgtcgcgaactgcaaccgttgccccattcacggcaccagctgctttctgggactgtttttgaaggttacttatcatatcagttatcttttcagcagactggcgggactccaaggcaagggctttcacttcggcggcaacaactgcaaaaccccttcccatttccccagcacgagcagcttctatcgctgcattcagggcaagaaggttggtctgattggcaatgtcggtaattaaccggacgatctcatttatctttttcatctcaccctggatgtctccaatgagctgatctgcttcttctgcactggatataataagacccatgccttgttctgcctttttcgcaaattctgaaccttcccgtgccatttcggtcccctcatgtgcaagacgtgatacagattcggctttttgtgagacatcccctacggttaccgagagatcctccattgccctgaggacctgcctgactcctgcatcactctgctcagtattttcagaaacggcatttgaatttcgggctacctgctgggagctatgagcaacatcctgaacactcgcattcgcctgctcaacatttgccgataactccataacctgcttgttaatagccatcagagcatcatgaacctgatcaccgatgatattaagagattttttaaactcgttccaatcgcccctggcctgaacagtatcctcaaatctggcagaaaaatcatatgcagcataccgtgagcagactcgcatagcctcgtcgaacgggttttttaccgaatgaatcaatgtctgaatatctgtggcaatttctttataaacaccggtatgatgggatagatccatgtgagtacccagctttccttcctcaatatccctttttatttgtgagatactggtatgcagggtttgtatcgacttcctggatttattgtaggcatccagaagctccctgaccgactgattcagatcaggattcttactgtcacgaggagcactgaaggtttttgtaagatcgccttcagcgagcgaggtcattccttcggtaatgctctttagagattctgatacataggaaagtgattctttatactctaccaactgaactccgctctcggtggttacttttctgatctcctgttcatagagatccagtatttcatttatcagacgtgcgagatccccggttccgtcggtcagggcagatggagaaattctgacctcaaatcttccattccgaactttttcttttaatgaagagatctctgctgataattccatccctcgttccctcgcatattcctaccattatctcatcatgggatcgtattaatatatggtggatcaggattttcgtatactctggagggtgttgcacaactcagatccccccataattttttaactaaggtcaatcaaaagtactttaccttagtacgtccaacatatactcaatgtataatacgataggtcgggattttgaacaactttaccttctccctgaggatattagagactgggttccgagtgatgatttctgccatatattaattgatttaatctcaattctcgacctatccccattatataaggaataccgggaagacggccaaggtgcggcattttatcatccagaaataatgactggtttgatcatttactcatattttaatggagttcgttcaagccgtcaaatagagaataaatgcagatacgatgtaggatttagaatagtaacccgcaattctctcccagaccattccacaatctcgcgatttatcaagaaaaacagttcttttattggacaacttttcattccagtattgactctccttaatgaagcaggattaatcaataacgtccttctcgccttggatggaacaaaactaaaggcgaatgcttcacttggatcgaacatgccatatgaaaagattgagggagaaattcaaaaatatctaaaggaagtccaagaaaaagatgatgtcgaggatcgtctttatggcccggataaatcaggtaacgaggttcccgatgattttaagactcactcaaaaaggataaaacgattcattcaagcaaaagaacgacttgaggctgaacataaggagaaatcccaaaaaaaggaagagaagattgcccaaagggaggaagaggagagagagtctggaaaaaggaaacgaggtagaaaacctaaaaagcctgcaaaaaaccctgatgagcaaagtcttgcaaacactacagatcctgatagttcaataatgaaaagtgggcctggttgtattcaaggatataatggccagataattgtaaaccaggatggctatattctggttccgtttttaagtaattcacccgttgattacagattacttcaaccatgttatgaaagattagaggaaattgctcaattaaccggcttatcgcttgaatatcttaatttacttactgatgctggttattggagctatgaaaactatctgtatatgaaacagcaggatattggatttctctgttctacatgccatgaaccagatattttcagtattagaggcctcgagagaagtttacttgaacttgaacgaatttccgatcaactttttgatggcatttgcagtattccaacgttagcatctattggtgattggtgtacgagaaatctcattcaagatgataatattccaacacccgcttctattgctaaagggattatggaagtgacaatgactccgtatggtgccaaaaagacatattcacaacgaaaaacgattgttgaacccgcatttggatggattaaagaaaatcgcaatttaagaaaattgcagagaaggggaatatcacattgtcaggatgaatggagtttgatttgtttaacacagaatcttcggaaggtctgttcaagaggggagttgaagaaattcagagaactgatcctgcaaaagaagcggcatattatctgtaataagggagtgggtattagaataccttattcaatattgtccgatgcattatcatctttgggcagaatgatcggagacaattttctaaagatgttgataagaaaaagtacttaccaaaaattttccaaattttagtcatgcaacaccctctctgtttctcatgttataaaacacaaatacttcgtgattctctttcgggagtaaaacaataacaaatatactgatgactgtccactttagtaatgtaccatcaatgagaggagggttggatgaaaattgaggtcttgaaggatatcagacttgcagaagaagactacaaaaagatgatttcagaggcacaggaaaagcgcaaaacaattattaccagtgccgaacttgaagcagacaacatgattcagaaggctcatgccgacgccgaagagttcaaaaaacagcggattgcagatgcacggaaagaggctgataaccgttatcagcggattgtcagtgatggaaaggctgaagcaatggctctggaaaacaaggggcggcaaaatctgccaaaagcagtagacctgctcgtatcacgattccgggagcagctcaatgtttcaacctgagtcaatgagcagactgctcatcgtcgcatccaagcagcaactcgagccagtcataactgaactgtatcgcatgaacatctttcatatcgacgactatgttgagaaaggagatggagaatgggaagggttcaggattggaatgccccttgccggggccgatgtcacatccgcggcacttgtgaagatacgatcaattgccagtgcatttggtattagtaaagataccgtcagtgacgcagaacgctcttcgatcaacgtattaaagcaacgcattgagcaggatctacctgcaattgctgaagaagttgagaaacttcttgccaaaaagacaaaatatgagtcgatggtcaaggagtatgaacagcggattgaagcactgcgaccatttattgatgcccctgcgccattggaacttctgcagggttatgataccatcagtttcatcgccggtaatgtaaaaagcccggtcagtctgtctgtcccctgtgaaatatgggagaaacaactgaaatcagggtattttgtcatacttgctgtgaaaaactcagacgtttcaacggtagagagagaactgctcgatttccagattcaaaagattcagatcccgacagaaaccggctcagcttctcaggttattcatgaatatgagctgaagattgaagggcttaaaaaggaaattgcagatatcgaacgccagatgggaaccatccgggacaagcatgaatttttcctgatgtcatcagaagaattcctttcaggagatgtagaacaggcagaagctccacttcggtttgctacctccgaacatgcatttgctgtaaccggctgggtcccgacaagtaaagtaaccaaggtctttgaaaacctggacaaggcatgtgcaggaaaagtctacgtctctgaacttgaggtcgaagattataatgaaatgccgccggttgaataccacaacccggactttgcacatccgacccagttattcatggatctgtactcgcggcccagatataccgaagtcgatccgacactgttaatggctattttattcccgataatgttcgggcttatccttggagatgtcgggtatggtgttatcctgctcatcatgagcatgggtctgaggtcatttgtaaagggcagtgaagcaggaaaccagctgatcactgttctccgtaactgtagtataagcagtatcatcttcgggttagcgttctcagaaatattcggtttttcacttccatggcagccgatctggctttcacgtcatattaacatgggcggagctgcacacggggcagcaactgaagctgcagcacatggaatggaagcttctgtagaacatgtatcacatatcccgcaactgctggttatttcgatctggattggtattcttcatatcacccttggaagaatctggggtgcacgaaatgccgcaaaaatggatcacggacatcaccggaccttaaagatctatgcgaacatcggatggattctggtcatgtggggtatccttgtccttatctggtcgaatttcccaatacccatgatgcctgacttttcccagttaccagcccttgtagccggtttgaatcctgccatgattgcaggtgccgtcatgcttattcttggactggtctttattgcccgggaaaatgttcttgacctcatggaagttccgacgattatcagtcacgtgctttcatatacacgtcttatcgccgttggactttcttccgttgcaatcgcaatggttaccaactttatcgcaattgatatgatcatcagcccccagctgaagctcctatcaccgattgggattatcctggtcattgtaggaattgtagtcttcctctttggtcatgcgctaaatactgcacttggtatccttggcggtggattacatccccttcgtcttcactatgtagagttcttcaccaaattttaccgtggtggaggaaagaaatacaccccattcgggatgattagaaaactgactaaacagacagattaaaaacaaaattattggagtttaaattatggcagcagaatcagtagcagtagaagtggcagcagcagcagcatcagcagcaggacttaaggcagtcggtgcaggtctcgcagtaggccttgcaggcgttggttccggacttggtgagatgggtatcggagcagcagcaatgggagctgttgcagagaacaaagacatgttcggtcttgctctcctcttcaccgttctaccggagactatcgtcattttcggtcttgtcgttgcactccttctcatgttccagtgagtgaggaaaagactatgggactggacgcagtcatcgcagagataaaggaaaaaggacgacatgaagcggagaccattgttaacgaaggctccgcacgcaaggatgaaataatgaatgctgccaagcaggaagttgagaagatacatctcactgtcagggatgaagtggagaagaacctctcccatatcatctcccaggaggaggcagcagcacatttaatcgtaaagcgtcaggttctgaacgcccagaaggatttaatggatcaggtgtacaagcaggcgcttgataaaatcgtctcaatgcctgaatctttccatgaagaggcgatcacttccctgcttcggaaagcaaaggaagagatcccaaagggtagggtcagctgcgcagcacgtgatgaaaagatcctcaagaatgtcctgaaacagtccgaattctctgcatacacattcggttctgtcatcgataccgacgggggcatcatcgttgaaagcgatgacggacaactgcaggtcgattacagttatcgtacattcctgaaccaggtttgggaatcaggattaaaggacgcatcagactctctcttcgcgtgactcagaggggtataagaaatggttcagaacagtggcggcccggctccgtatatctatgtcagtacacggttacgggtcaggaaggccaaactgctcccccctgaagaatatcagcggatgctcaacatgagtcttccggagattattcgtctgattggagagacagagtaccagaaagaggtcgatgagctcggaacttcttttgaaggtatcgatctgattgaggtcgctctttcctggaatcttgccaaagaatatcagcgggttattgaacttgcccccggatccctcaaggaattcaccatggcataccttcgccggtgggatatctataatatcctgaccattctgcgtgggaagatacagggcatgaaggaagggaagattaaagaagtacttattcctgccggaagccttgaccggactatccttgaccgggttttagcagaagaaaactgcgaacgggttgcagacgctctgaagagctggaaaatgtatccgacactttctgcagaactttctgaaggatgtgccgttggttcatttgccagacttgaaaatgagctctacaagcggttgtatgcagatcttctccagattgcccggagaggagtgaagggaggtaaccagttcctgaaatttgttcagctggagattgatgtgaagaacatcaagacgctctttcggatgaggggtgacggatatgaagaagatgcacgtgaatttttcatccccggagccacattcacccctgaagagctgcaacagatgaaccagatgaccagcaggaacgaggtcattgatgccctgctcgcacggataaaggcaaaggctattcaggttgccctggaagatctgagaacagaaaagtcagagcaggaggtcgatgctgaacttaccaaaacacagcttgaccatatggaacagctctccaagattaatccgttctcaattcatcctatcctcgtctatcttgaaaagaagaaatacgaggtcttcaacctgagagccatagcccgtggaaaagaatcccgtcttgccggtgataccatcgcaaaatatctggtgatataatatggagatcgcggtaatcggaaatagtgaattcatcctcgggttcaggcttgccggaataacaaaaacgtacgcggcagaatctgatgaaaaggttgttgagtatgttcacaaggttctcgatgatggtaagatcggaattcttgtcctcaacagcagtgatatggcaaagattccagtacgactccgcactaccctcgaaaactcagttcacccgacggttatcacacttggtgaggaggaaggcggattgtcgatgcgtgagagaattaaacgatcagtgggtgttgatctgtggaagtaaaacgaaccaaaggggttttaaagagaattgcaggacctgtcgtcactgcagtcaatctcgacgcacacatgtatgatgtggtgaaggtcggggatgagcagctgatgggtgaggtcatcaagatcaagggtgaagatatcatcatccaggtctatgaggatacctcaggcatcaagccgggtgaaccggtagagaacaccggtctctcgctctccgttgagctgggaccaggacttctgaccagtatttatgacggtattcagcgtccgctcgaagtactggtagagaagatgggaaatttcatcgagcgtggagttactgctcccggtctctcccatgataagaagtgggaatttaagccaatcaagaaagcaggcgatatggtaactcccggcactattatcggagaggttcaggagaccaatatcgttcacaagataatggttcccccctactgcgacgcagggaagatcaaggatatcaaaagcggttcctttaccatcgatgagatcatctgtacccttgacaacggggcagagatcgccatgatgcacaagtggccggtgcgtatgccccgtccggttacggaaaaactcaatccggacattccgctcatcaccggtcagcgtattcttgatggtctgttcccggttgcaaaaggtggaacggcagcgattccaggaccattcggatccggaaagacggttacccagcaggctcttgcaaagtggtctgatgccgagatcgtcgtgtatatcgggtgtggagaacgtggaaacgagatgactgaagttctgaccgaattccccgaactcgaagatccgaagactggccggccgctcatggaacgtacggttcttatcgccaacacctcaaacatgccggtggctgctcgtgaagcatctgtgtacaccggtattaccattgcagaatacttccgtgacatggggtacgacgtttcccttatggcagactcaacttcacgttgggcagaagccatgcgagaaatctcatcccgtcttgaagagatgcctggtgaggaaggatatccggcataccttgcagcccgtctgtctgaattttacgagcgtgcaggtcgtgtaaacaccctgaacaaggactttgggtcagttaccgttatcggtgcggtttcaccacctggtggagacttttcagagccggttacccagaacaccctgcgtatcgtcaagtgtttctgggctctggatgcaaaactctcacagcggcgtcacttcccggctattaactggctgaactcctattcactgtatctagataccttaagccagtattatgatgagaatgtctcgcctgagtggaacccgcttcgtacctgggctatggaagttctccagaaagaagccgaactgcaggagattgtgcagctcgtaggttcagatgcactgcctgatgaggaacaggtcaccatcgaagttgcccgtatgcttcgtgagatcttcctgcagcagaacgcattcgacccggtcgatacctattgtgacatgactaagcagtttgacatactcaaggcaatcagattctattctgaccaggcatatgcagctctgaaggccggggtcatcacctctcaaatcaccggtctgaaggcaaagaacgacctcccacagatcaagtatgtcaaggaatacaagcctgaaatcgaaaggattgtcaagacaatggaatcagagtttaccaaactccgggaggcggcttagatgaaggagtacagaactatcacacaggttgcaggtcctctggtctttgtcgagaagactgaacctgtgggataccaggaactcgttaatctcgtccttgcagatggatcagaaaagcgtggtcaggtacttgatacctctgatgacattgtcgtcgttcaggtgtttgagaccactaccggtattggaaaggacaccggtgtccggtttaccggagagaccatcaagatgcccgtcggtaaggatatgctcggacgtatcctctccggtgcaggaaagccaaaagacggcggtcctgacatcgttccggagaagcgtcttgagatcaccggtgcggctatcaatccatgggcacgtggttcaccacgccagtttatccagaccggtatatcaaccatcgatctgacaaacactcttgttcgtggacagaaactgccaatcttctctggatctggtctcccccacaacgagattgcactgcagatcgcccgtcaggcaaaggttccaggatctgatgaacagttcgcagtcgtgtttgctgcaatgggtatcaccaaggaagaagaaaaccagttcatggccgagttcgagagaaccggagcacttgagcatgcagtggtgtttttaaaccttgcagatgatccggcagtcgagcgtatcattaccccacgacttgctctgactaccgctgaatatctggcattcgagcttgattaccatgtgctggttatcctgaccgatatgaccaactactgtgaagctctccgtcagatcggtgcagctcgtgaagaagtgccaggtcgtcgtggatatccgggttacatgtacactgaccttgcatccctgtacgaacgtgcaggtatcatcaagggcaaaaaaggttcagttacccagctgtccatcctgaccatgcctggtgatgatatcacccacccaattcctgatctgtccggttacattaccgagggccagatcgtggtgaatcgtgatcttcaccggaagggtatctatccaccgatcaacgttttgccttcactttcacgtctgatgaaccttggtatcggaaagggtttcactcgtgaagaccataagaaagtctcagaccagctgtatgcagggtatgcagaaggtgtcgatcttcgtggactggtggcaatcgtcggtaaggatgcactttcagagcgtgaccggggattccttgagtttgccgagatgttcgagaaccgctttgtccgtcagggcaaggatgaggaccggaccatcgatgaatcactggatcttggatgggatctgctcaaagacattcctgaagaacaacttgtgcgtattgaccgtgaacttattcagaagtatcatccaaaataccgcaagaaggcagagtgagcctccatggcactgaaagatgtcaagccgacacggtctgagcttatcaatatcaaaaagaagattaagctctcccagaacggctacaaaatcctcaaaatgaagcgcgatggactcattatggagttcttcaaagtgcttgaggaggcaaaggactccagaggtgctctgcttgagaaatatgcccgtgcacaggagatgatggctatcgcaaacaccattgaaggttcaatcggtgtgaaggcagctgcattttctgtccgggaaaacccggatatcaccctcaagagtaaaaacatcatgggcgtcgtggttccggagattgaatcaaccaaggtcagaaaaggtattgcagatcgtggatatggtgttattggcaccaccccggtcatcgatgacacagcagctgcctttgaagatctggttgaagcgatcattaaaagtgcagagatagagaccacgatgaaacgtctgcttgatgagattgaatccaccaagcgtcgggtcaatgctctggagttcaaggttattcctgaactttccgatgcacgtgactttatcaagatgcggcttgatgaaatggagcgtgaagagttattcaggctaaaaaagatcaaggccagatctaccgcataattttttaattgacattttttctgttcttcgtttattcctttataggcttttttcaaaaattagggacatattgagaatttttctctgtatcaattatccttttttcaccattcccactgaatgaattgttataccaggagtaatgattatcagcaatcatggagataaatcaggaaaagtatgacacttgtgaaaatatcagaaaaaggacagattgtcatacctgcagcattccgaaagaaatggaatctcgaaggagattcaacgattatactcacggatgatgcagatggtatacatatcagacctcctgtccatctctctgacctctccgggatcgatgaagggaagggattattacagaaacttcaggagatgagagaagaagaaggggacatttaatgccggatatgcttttcgacacacatgcatttatcaccatgttcgaacgacagccgggatgggagatcgtcagggactatatgagagcagttgatgatgacgattgttcagggtttattccaacggttgtactcacggagattatgtatttgtacactctccaagagggacatactatcgcataacagagaattggacagataatgaattcccgaatgaaaactctcccaatggatgaaagcttttcccttgtggcagggaggattaaaaaaccgggtatcgcattggctgatgcatgtataggagctgctgcacaagttcacggactttcggtattatcagaggataaacactttgaccagatgaatattcagcgaatcggctatccgtgaaattctggacaaaggagtatggtagcccaccatggtgatcttcgcctgaatacaattgaaggttcaattgatgtgaaagcagccgcattttctatccaggaaaacccggatatcaccctcatgattaaagtatcattggtgttttagttccggagatttaaccaacacaggtcagaaagggtattatagactgtgtgttgttatcggcaccccccggtcatcgatgacacggcagtttcctttgaaaacctggtagaggctatcataaaaatgctgagatagagaccacgatgaaacgtctgcctgatgagatggagcgtgatgagttattcagcctcaaaaagatctaggccagatcaaccgcttttataaacgtccgaattattatcgcaatatttcaattattttctcatttagagccatattataatttattgtattagaataataaaataaaatattcttttatgatgttcacaactgcagatctcattagccatgaaacagaaattaagacacataaattcttttaactattgtaatttatgataaatctcattttatttcatcgaatattaaagccctacaatcaatcgaaatacagccgcactattcacataaacacttgcacccatagtaatataggatcatcataggaaaaaactacgccctgttgtaaacacatcttaaaaactctatttatgaacacattttttcttacatcaacatcactaaaatttaattctactcaaaaatccaaacacaaaatcatatattattaaaatacatattctaaaaaaatttataatattattatacatatgatcgcggattaccagctggaccgtgtcattcaggaccaggcgaaatcatttgcacggaaagatcccggaacacccaggtccatcaatctctttaagtatctttatcttaaccaggtgatcatcatttccggtgtccggagatgtggaaaaacaaccctgctcagacagattgcatctcattttaaggcctatcattatctgaaccttgccgacatccgtcttcatggactatcagacctaactgccagtctgcttcttctggaaaagcgagacccaggaatcaggatcctctttcttgatgaaatacagaacctgcccggatgtgaagataccatcaggcaattacatgattcaggatacaaaatattctgcaccagttcacaaactggctccaatatctctcattcagataaaccaaagggagaatgggtcactattatccttcacccattttcatttgtcgagtatctcgcctggcatgcaatagacaaaagcacggcgtctgaaaatcaggtagcagtattgtcacatctggacaggtatctggaagaaggtggttttccggagtataccagaatgtgggatacagatcatatcagaagtatatatgaagagatcctgtaccgggactgtatcgcacggtggaatatcagggatgtttccggatttatcagactggcgggcttccttcttacgaacattggaaccaaagtccattaccgatcccttgcctctatgctcggaatgaaaagtcccatgactgtcagggattacatccatattctggcagatacgcatctgataaccgaagttcaccggtatgatccatccctgaagaaacagtatgggaccggtaaaaagatctatgctgtcgatatcggtatgagaaaccaggtagcattcagggtttccggggatcatcaaaaactcctggaaaatctggtgttggtagagttaaaacgtcgggattttgatgtttatcccacattcgccagatcttttttcaactatagaatttttcgtactccggcccaagcaatcgcaatatcttcaatagttctcgatccaaattctggatagatgaatggagtgcatcatcgacagaaataatacatgacttaatctctctgaatttaaaaaaaatccatttgagcgttggacgagaggtaggtttcttcttctgattcaacaccgtttcatcttcttctttcagcctttttcgcagcagcatttcagtatatgagtaaaccatgaggcagagaaccataaccatacataaagcctcgatccttttttcacttttcagataaacttcagcaacccggaatgatttgtcctttaaaaaccggaaacctttttcgacaagcatctgtcctttatagtgattcagaaccgtttcagaatccaaactcaaaacattcgttgcaagaataaatctgcccagatactgtttttcactttcaacgaaatcctgagcaagttcaacccttgcatcgatcgaatattgtgggattaacgtttctcctgcttttgggcgccccttcttaccattttcccgtttataactgaccttgatccttgaatccaccaattttactaaaggtgtttcattaagatagcgtaagagagcgttactggcatctgtttcacatgcatagcatactttagaaatctgttttaacccttttaatgcggctttgaacctcacagggaggtttttctcaaacgtcttcaattctcgagctttcatctcttcagatgagacaacaatccatttttgaggaacaccaccataatgtgagtcaacgctactgcaagaataccgtggatctgaggtaggagtgaagagaagatcagatttgagtaactctgtcatctcatttattgtggctgggacatttgatatccaccttgtttccggaccgagggttttgatgtttttatcagtatacagggcactgtcacccatgaagattacatcaggatcaaatgtgaatgaatcttgcaatgataggattgtttgcacaagaacttccttatctgattcgttgccatcgtgtgcacgagcaaaaatcggtatcccgtgttggttaaccaccatacttaaggcaaatctgtttaaatcccagcgtttgtcttttggatgtccctttgtaattttgatacatccatctccggattcatttccatattcaccatgaacactgaaattggttgtatcaacatgacaaagctgtactccatctttgtaaacagtaaacatctgggtgacaagatcagtaaagagcttgctggggccatatgcatatatcttatccaaaaggcgaccaatgactgattcattaagattttttgcagaaatatccggacctatgagacgttccaaatcaagatgcttgcagtattcgggaaaaagatagagtcgtctctctgtgaatccaagtccgttgagaatgagggctaataaaatttgagaacttgatatttgatgttgaccgattttagggattgcccggtcaattataggagctaaaccaagcttatggaacgtgcctgcaacgattccaagatgatcaatggtttttatggagtctatttctaatgaaacatcctcatctttcattaattatagtaatggagatcttcttagttatatagtttactattatataaaattgtaatagatctgacgaatatgggtttattatcatttttcggctaaggaatgtgattttgttattattgagaatggccaggtaaatggtctgtatcaggtctgctctgaattaactgatctgaacagggagcgggaatatggtggtttacaggaagcgatgaaccaatatggacttgactgggggatactgattactctaaaccaagagggaacagttcgggttccggaaggggtgattcagattgtgccggtgtggaaatggttgttgtatatcgaagaaaaataatttttgtcgataaagattaaaatttggagttgacccttcatttatgagctcttaatttctaattgtattatttatacgtcatgatgaatatttatcaacaaatttttataaaggaatcatcttatgtgatgaaggagaattattgtcatgtcagatatttgcttaaaaatacccagtaatattacaaatacaatccgtcttccacccgatactctacaggaagaattactcaaggaactggctattgctttgtatacaagaggaattttaagttcaggacagtcctgtaaactagccggaatgaaacgatatcaatgggaagaggaattaggtaaacgaaatatttctcgccattataatctggaaaagttagaggaagacttttcctatgtttttcatagcaagtgattcttcaccattaattagtctggcatcaatcgaccgattctgtatccttgaaaaacattatgatcatattatcatccctccggcagtttgggaccgaaataactgatgatccacacagacgaccaggatgtttagaacttataaaagcccgtgatacgaattttgtaaaaatcattaaccctgaaaaccttcatcttattcaattattaaaaaaccaattacatgaaggggaagctgaagccatagctctggctcagcaggaaaaggcaccaatccttcttattgatgaggctgaaggtagagaggtggcaaaatcatataacataccagttattggtgtaattggcatactcgctgcggcaaaaaagaccggtgagattgaatcaatgaagaccgaattggacagtctgattcaaagaacctcttttcgtgtttcacgaattatgtatgataaagcacttgagatgtcaggtgaattgtaacaatttaacttgattaaaggcgatgaaactgaatataatcaatgtaaaaaggaatttattaaaccaacagtgaatgtaaaaaaatcccctgaatggactgctgaaggaattccaccacctacaggtatttttcaataaaaattttttccatgtatatttacagccgacactcggcagcaacgagtgttacgaaacataatttttgtacaaacatttaaatctgagtacgttgtatactctttttgaataatgtccatcgttgctgattcaaatgtaaccatcgctcacttaggcatagtctcagggataatagacaaacttggaatttgtgaatatatcgatcggctcattcccaaaaagcgtagccatattgtcactcatggcgaggcagtgaaagcattacttctcaattgcctgggttttactgaacggcgtctttacctgatgccagaatattttgatgatgttgcaactgaacgtctaattggcgagggaattgaagcaaagcatttgaatcagtacttatttggtgaaactcttgatgcgatagccgctgcaggtcccactgagttattcacgggtatcatccttgaaatccttgataatcttctccatggagttcttcgacttcattatgatacaacaacgatcagtgtaacaggagagtatgatcaagaactaaatactcgtctgattaagctggttcgagggcattcaaaagatcaccgcaatgatttgaaacagttagtcctatgtttagtaacggatcaacgtgggattcctgtttttatggagcctttatccggtaatgcatcagataaaaagactttaattcgaaccattcaggaagtgcgaaagaatttcaatacagacgagaaggtttaccatatggccgattcagccctttacgccgcaaaaatggttcaagatctaggttctcactgttactggataactcatgttcctgaaacgattaaggaggtaaaaactatcctcaaatctgacgttgagtggattccgtgttctgatgcccggtataagtatgctgctttcgatagcaactatggcggtatcgatcaaaaatggtttttattccactctgaagagagacataaagccagcatcaaacatgatattgaaaaaattgaggagaaactggcgaaaagtcagactgccctgaataaatcattggtcaacgggtttgcttgcgaaaatgatgcacttctcgctgtagaaagatggatgtcaaagcataagcgatacatcctttctgatattgaaataacatgtgataacaaaaaaccgtcaggtaaggttgggagaccgaaaaaaggtgaggtacttgagaaatggtattctgtctcctgcaaattagcgctaaaccaggaggttattcaaaaagaacaagcaatgatgggtcggtttattctcgctagcaatgacactactgtcgatccgaacacctgtcttgaatattataaggaacaaaatgccgttgaaagaggattcaggttcataaaggggaattcttttcacgcatcagaggtttatctggagaattcaaatcgtgttgcagccttatccatgataatggttctatgccttctcgtgtattcgttcacagagtgggtagttcgtgagacattgaagattgagaagaaacaaatccgggatcaaaaaggaaaaccaactcagagaccatctgcaaaatggttgttcttcatgttcagaagagtaaggcagattaaggaaattgataattccagaataattgtgcgaattctaaatttcactgatgaattaagagatattgttcgattgatagggccgcatgttgaaaaatattatgcgtgaattttttggtgccgagtgtcggttacagcagagatatcaattgttattaatttcggggacttatttcattaatacccgtatactctgataggtcttacggttaatgaatatccggaatttcaatagacagccctacgaaatctccttcggcctcaatgcgacccatatcatcaataaatctgcgtttttttatcctccaccatgaacagaagaatatcatcgaacgtttgaccaggttgttttagctcatatatatcagcccatacccattaagatacgggatttttttataccaaccattgagtattgttgtcactaccatattttcagcattgaccagagcaggaaaaatattacccattacaggaatttttttcaatatattttatttagccatatttccataatttgtgaaatctgcgataattctatctattcgattgataacagataacatactttaggtttaactatactatacgatgaggttcttcaacactgccggacctgtcaattgccaggatcattattgcctgcctccattaagccgttttaatctcacagaaattctctcactcatcgcacaaaaaaatattttgttcttcatgccccacgacagaccgggaagacctcatgttttttggtctcagggatcagttgaatcaggaaggaacatactctgcattctatgtatatgtcgaaatgggacaaactgccagaggtgatgttggcaaagggatgaaagcaaaccaatactcacagaacttgcatttcaggcagaacggaccctgggggatactacatatcgaaacaggatctccgaaatcattgcagaatccggagaagatgctgccctgaaatctctgttatcagactggtgtaaaagactaaaattgcctcttgttctctgtattgatgacgttgatgcctttgttggtgataccctggtttctcttctccgtcagatccgttcagggtacccggaaagagcaactgaacttccatcctcaattattctctgtgatgttcatgatgtccgtgattatcggattcattctgaccgggaaaaggagattgtcaccggtgggagggccttcaatattaaggcaaagtcactccgtctgggaaatttttctgaagaagaaacaaaaacgctccttcaacaacacaccacagaaaccggtcagatctttgaatatgatgctatttcagccatatgggccctaacgaaaggacagccatggctcgtgaatgccttagcatataaagtctgctttgaactcccgatgggaaaaaccgggcaaatcatattacactggatcaggtcatcgacgaaaaagaacgtctcatcaaacggcgggacacacaccttgcccagcttgtagataaactcaaagaggaacgggttcgacgggttatcgaacctatgctcactggggaagtctttgaacaggacttcaggcctgatgatgtcgtagacctgatagatcttggccttataacatagtaaatagccggtgctatcaagattgcaaaccccatctatggagatcatcccccgtgaactcagctggagaacacagactggcgtgaccatcgaaaccgcctgatatgttgaacagaacgggagactccttctttcaaaatttatcagtgcatttacccagtttttccgggaacattcagggagctggcttgagatcactgaatataaagaggccgggtcgaatcagttactccaggcattcctgcaacggattgtcaatggtggcgggcagataacacgggaatatggtcttggaatgggtaggactgatctcttcattctctggcttctttctaatggaacaaaccagcggtttgttatcgaatgtaagattcagaggggaacacgagaaaaaacgatagaggcaggagtaactcaggtaaccagatatacagacacctgcagagcagaaggggtctatcttgtaatttttgacccttcggataaaccatgggatgataagatattcacggaaataagatcgaaagacccgtatcaggttgaaatttttggtatgtgaaacgagtactcatcaatatttctcgtttcaggatcaaaaacaatcccaatttctattaattgtcttttatcagaacggtatttctcagaatatccccggttctgtatttgctcgagaggacttaagtctccggttttgtcgatccctttcaccttaaattcaaagatccaggtatatgatgcagttttaaccgtcagatcaatgcgacccttgtttgtggtatcttccgggattatctcatatccaagacttgcaaggtatgaatagaccagacttgcccagtacccttcaaattgtgcaagaggattttttctaaacctgtcatgaggaatcgaagccaaaaaagattttaattggcgatgaaacccatcaacattcccagaaccaagaagttttcggatatcaggaaatgataggggtgtagcatcctttctgagaagattgagaatgcttttattaaatgattctttcacttccctattcgggaaaccaagggtataccatgttccttcctccggattactggtccaggatttgatcgtaagataccctgcctgaaagagaagggtttcaagccggatctggtcaggatcaaaagacccaagcagatcatccccggctatgagcccttcatattctgccgggattcttggctgtgattgccagagttttaaaaaaaaagatggcgttccggtttcaaaccaatatggcttgaaaagatctgaatcaaaatagagcagaatatcaaagggattatatacagactcaccagtccaggaatacccgttataccattcacggacgagttttggatcacatattgcaaaccatgacgagaaatcatccctgatattttcttctgtatacccacagagtgaagaataccttcggtcaagcgtgatgtctttcaaattatttagtccggaaaaaatcccggttttaacgaatttagatactccggtgagaaagacaaatcgaatatgagaatccagaggtttgattaccgcataaaaatcacgcaggacgtcacgcatctcagccgcccgggatggatcctcaagaacatcgagaattggtttgtcatactcatccaccaggattactacctgttctccggttttttcgtgaatttcccggatgatggcagagaatcgcccacctatggttgtttcaaaaggctcaaaatcccattcccttgcccaggcagagagaatctcatggatccgggtttttaactcctctccagttcggggagaagataatgaccagtcaattttcagaaccgggttttttctgctccagtcccaggcagcatccggcgtatccagatataaccccgagaacaaacaccgttctccggaaaaagcacaatgaaatgtatctatcaatagactttttccaaaccgacggggacgggagaggaaataatatttacctgatctgacaagtgaagatataaaagaggttttatcaacatacacatacccaccggtcctgatttcaacaaaagattggataccgatgggtaatttcaggtcagtcattcatccattattatacccggtttgatgtaaataagttattcatcacaccacagaaagaaaatatgagtaaacaatcgatttaattaaatcagataatgacaggagattatgtacttccagcttgaattgagctgtgatttttccgaaactggcaataaccggggaagtctatgggcacatattcaaaaattaaaggattatctgacgttgatatttcaggaaagacagttctgctcagggttgattttaattcaccaatcgatccccaggccggagttatccttgatgataagcgctttcgtgaaattctgtatacgataaaagcattggacaaggcaaaaaccgtcatcatcactcatcagagcagacctggaaaaaaggattttacttctcttgtctcccatgctcaccgactttcagaactcctgggaaaagaggtcagatttgttgatgatatctttggaacatgtgcccgggatgctgtccgcaatgcaaaagttggcgatgttatcatgctggaaaatgtccggttcaatgcagaagagaacctgaaactatccggtgaggagtcagcaaagaccgttcttgtgaaaaaccttgcacgaatgggcgatctcttcatcaatgatgcatttggtactgcacaccggtcccagccaaccattgtcggccttccggaagtgctccctgccatagccggactccttatggaacgggaagttgaaaacctctcacgagttttcagtggtgctccccggccggtgacattcatccttggcggaacaaaggttgatgattcaatcgatgttgccagacatgtactcacgaacggcatcgctgataacgtccttgcggtcggtgtggttgctaacattttccttgccgccaaagggtacagcatcggaaaaccttcgatggacctgattgaacaactcggatacattggacagatcgaaatcgcgaaagatatcctttccaggttcggtgaaaagatcgtcgttcctgaacatgtcgcgataaaaaaagagggtgccagggttgagatgcatgtccgtgatatcccatcagactgccctattctggatcttggatctgaagggctcataccctgccttgatgttattaaaagatcccgcaccgttgtattaaatggtccggccggtctttttgaagagtctgattactcattcggaacatatgaaataattaaagctgcagcagaagctgagttttccgtcgtcgggggaggacatactgccgctgtcattgaaaagatgggatatgatagaaagttcacccacatctcaaccggtggcggtgcatgcatagaatttttaaccggcaagaaactaccagctatagctgccctggaaaaaagtgctgaacggtttacataggccgatataaaaaaggcaaccttaatttttctgcgactgacctcataagaagatttctgaatatatgaatgatacaaccattacccttgatcacattgcactacaggtaacaaacctggagcgaagtatccgcttttaccaggatatcctgcacatgcaggtctatggtccggtccatcttggagcgctctccacaggcgggaggattttaggaaaagtcgccggcggtcatggtcttttaaaagggatccttggcagcatctcatcacgggctcttcgtgatcagtataccgatgtggctcttctttcatcttctgggagatcatatgatattctgcttgtccaggaacgatacccggaaacaaacgctaccagatcggttgacggaaataccatattcggattttcatgctttctttctttagcagttgattcagagatccttggttgggatcttcatcaggctgaagctgatttttcctggggagatccaggtcttgatggaactatcttcacacaggattgccccaatcactccctgtatgtccgcgatcctgatgaccggctcattgaattaataccgaacagaagtgatgatggatcggcccccttcatcaccggcctgaattcaatcactctgcatgtgacccatccggataaaagcaaacaattctatagtgaaaaacttggaatgaaggttgaatctgatatcacgagatcaggccaagggaaacgatttatcaggctggaaagcacagagggaaaaatctgcattatcctgtatggtctgacaaaaccagatggaaatcccatagaggcgggaggatacggacttgaccatttcgcaataaccggatgtcagggagcaggagagaaatccacagatgcaatagatatctggatggatccagagaaactatccgaacataccggttcctcatatatcagggattatgacgggtactggatcgaatgtatctgaatttatgctttaccagttttttgagatgatcaatgacgatatcatggagagtagtgggaggatttggagcccacattaaatcaaaccggactgaaatcactattcagcataagggaaaaattactgatataccaatcaaagacctctctcattttcttctcatcggtggtcataccatccagacatcaacgataacatccctggtaaaagaaggagtttttatctcattttgtgagtctgatggtgagccggttggatatatttcaccctatgattattctcttttcaaggagattcagaatctgcaaaagactgcagctccgtattcatatgcccttgcctgtgcaaatgaatcaattaagtccaggattcttgcaatagaaaaatatgcagaagagattggaccggagattcttttctccggagaacttgacatccttacagggtatgcgaaggaactggaaaacatggttcttattgaagaactgcggagaatagaacaattggtccgggatatgtactatgaaatccttggtcgactcatcagtccgacgtatctttttaaaagaagaaccagtcgtccgtaccttgacccggtaaacgctattttctcttttgggtatggaatgctctcatcagcatgtacacgggctgtcatcggtggacatttggatcctggccatgggtatttaaacagaggaaatcaggcccttgttcaggatcttatgaactgctggaaaccgaagatgattgacaaccatgcgattggatttctgagatccggcaggttacatcagaatggctatgaacgaacaaaagatcggtgtattctacatgatgaggttattgaagaattaattcatcttttttcaaaatccattcaggaagaacttatcaatacacagatagatgtgctcattcagtcattgcgaggagaagcacagttctcaattatcaaaccataggtttctaacggaactatttttccctaacttttttctccacagtttttattttcatattttcacccaggtatatatttattttaataaattttacaatatttttgtatatctaatatatagcatcatatgatttaatatatgaagattgcgaagtggcattgagacaattatattataataaatataaaaataagttaaataaaattagaaatacaggataatatttccttttcaaatcctttggcaattgattcgtccgtggattccacgtataatctgacaagaggttcggtcccggacggacgaataagagcccaggcatctttccgatctattctgatcccatccacctgattcaaagagtcccgtgaaaatttttctcgcactgctgtcaggatttcggaggctttatcggtgtggaatttatgttttaacattattgaaggggggagtgaatcgacgagggtggaaagcggttgttttttcgttgcaagaagaagaaccatcattgctgccgtcatacccccatcacggcagaactgatgatccggatagataaggccaccatttccttctcctccaaaagcaactggttttccttcggcaatgagtgcccgcatccgtctggcaacataaatactaccaactgcggtataatcaaccgtgcatccatgaggtgcgatgaccgtctcgataagtctggacgtgctgaccggtgttaccagaattcccttcttttgtgaacagatatactcagcaatgagtgcaaactccttattttcttcaacgaaccgccccttgtcatcgataaagacagcacggtccgcatccccgtcatgggcaacaccaaatgctgctccggtcgaaacaaccatctctgcaagcggggcaagaccctcaatggacggttctggatcacgtgccgggaagttaccatcaggatatgcattcaaagtgaagatcttacacccgatggactgtaatatttcagccgttgtccggtatgcagcgccacacccgggatcaatcgcaaccatgatgccttcacctatcttttctgggacttttttcacaacaccggcgatatatttggataccagatccccttcgggaatgacgacaccaacatctttccattctttcaggtcaaagttgtaagaaaagacccgttcttctatctcgatagatgcctcatcatccatctcggtcccgtctttttcaatgaccttgactccgttgtaggctcccggattatgtgatgcggtaatgactactccggcatcataccggttcataacgatatactgaagtgcgggagttggaaggatcccacagtctataacattacagcccgttgccataaggcctgctttcattgcattaattaatgcaggcccggaggttctggtatccatgccgactgcaatggttcccggtctcatagagccgacagccattccgatcttcatgaccagttcaggagtgattagttctccaacgataccacgaactccgtttgtcccaaataactgttttttcttttcagtcatatgcatcttcttttgtttcgttttgcatgccgggatcttcctccggttctgctccagaatccttttttctgcgtttttcctgcttttccttcagctgatcttcacgaatcttcaggagacgtgatgaagccagagcaacatgacgcatcacctcagttacccggtcttccacttcaatctcatcatcaacatcaatagatgtgctctctatctccatgagaaaccgggcaacttcacttacctcaaacaataaatcatcaagttcttcaggtgtataaaacccgcacattgctccatagagaaatgttgcaccagccttactcacctttttcttaaatgaacttcgtgcctggttgactgcctgtggcgtatatgtcccagtcatgaaaggaaccagttcagggagatttttcccgatatatgtcatttcagcccctgaggaagtctgaaaatcagcacataaccgtgatatcgcccattctctggcggtgatgaaggtcctcttcctcaggaattggtttacctgcagatatgatgcgccgtctaccttcctgaacttgtgatacttggtaggatcccgtgaacggaatggtgttgccatcagtgtaccgttagatgtgccttacagataagtccacgggatgaagataggggatgcaggcatctggttttttatggaagagagataacatgtataggggttgttcccaaagcccagatagtgtagtggcctatcatgtcggcctgtcacgccgacgactcggattcgaattccgatctgggcgttcattaatcaatattatccttttctgaatagccgccagacggaacccatatctcaaatcgagcgcctttcccataagtcccggtttcgaagatccgaatcccggttattgataatatttcccgaacaaggaataatccaagaccggtattacttccatatccccgatcaaaaatcctctccttgaggtcatcagggataccctgaccatcatcctcacagcagatacacacctcattgtcaatagagtaccatgaaaaccggatggatgagagattcggacctgcatgccggagggcattatctatcagattgtaaaatacccgctcaaggaggggatctgcatatatgaaaagaccggagagattattctcaacagtaatccgttcaggaatgccaatttctgctgccttacgaaccagaaatcctgcatccttccattctggtgactgaataccaaggttctgatatactcgcgtgaactcaatctgatcatgaatgagtctggttgcattatccatgatctttacaatctctgccgtctccggatcattcctggcctcctttagcaggggaagaagtccaagaatgacggtcacacggtttctgatgtcatgcctggttatgctggagaggagatttaatttctcatttgtccgcatgagtgcctgttcagccatgatccgtgcagtaatatcacgcatgctctggatagcgccgataatattcccttttgaatcgaataacggtccggccatcgatgagaaatatttccctcctttccccatcttcgggaatgtttcatcggtaaagagtgaatcgcccgaccggctgacattcgggaagagttttatgatggtaccttccttgtcaagaacggcattgaggagcattggcctcttttctccatagaatggtattgcatactcatatcttcctcttccgatgatgtctgcctcctgaatcccagtcagatgttccatagcctgattccagaagattacccatccatctttgtcaataacaaacgttgcatcaggaagcctggagattacatcgcggagttgtcgggctgattcacgaagagcttcgctgtcgataagtgctttccaggccagtcgctgttcggtaatatcctgaacattcaacgaccatacggcattgtcagctgatgttccggagaggatggtcagatcatgaagtgccggaaagacagagttatcagatctgatgtgatcaagttcaaacgtggcatggccggaaaagagagcactgtcaaggtatgacagaaaatttttctccggatacctggttcccacaagaaatggattttttccgatgaactctgcaggttccattccatgcatctgtgaatatgctgcattgacatagtcgacatttgccccggtcccggttacgataccggtgctggtatgttcaacaatatcggcaagtttccgaagtgagttctcaatctcttttcggtctgatatgtcaattgcaaatccacgaaacccggtaacctgtgatcctgaccaaataggggatgcatatacagtaataggataggtctcaccattgtggttaattcctgaaaattcagtcccgttaattggttttccctttctgatctgatcaagtgcctggagaaactgaggatggctttgtgggtgaataaaattcaatatatgaaaaccggtattcttatcatccattcgatgtccggatatcttcattcccatctgattgatgaatgagatattcccatccaagtctgcttcaaaaacgaattcaggtagtaaatccgcgagttcacggtatttgcgctcactttcagagagaagtcgattatgttcttccagatccttttgtgactggtttaattcaagaaaaatgggatgtatctccttggcgagtctggaaaattcgtcatcaccctccagaagaggggcatctatctgtgcacgttctgtgttccggtttttaatattctctataagcgttcgtaacctgaagagaacaaaccggtcaatgattatgagtgagacaacgattactacaaggcccaggatcatgaggaatagtataaaggtcagaattgttgctttcccctgtgtgattatatctctgggtaatgtaacggtaaactcaagaaagccatttgaatcaatggatgaaagatatgacgttcctgttatgtttgtgtcagattcaggtgttacgattatatcggaggtagttatttcattgatctcattcagggcttttataagtggaaagtcatgtattgatgagatggtaagatgtagatctgctatacttgacaatgtcttaacttttgcctcatttaaatattcaatacatatgagagttccaaccgatggaccctcatagatactggtgatgataggttcagcaacaataatagcaggaccatcaggcaggatgatgaaaccagactttccatctagaatcgattcgaatgtacatatatccgggatggagagtacctgtgacaggatctcatcagggacggattccattcgccctgcggttgtatttatcctggttgcatatttgagggtgctatcacctcttacaaaaatcaggagatcgataccaagattgtggatagaggcataattgaggttttgtatgatgtactcatcgtttttatcctgaacaaaattgtacgtctcatcccaccgtgaccagtccccggtcagggaatagatctgatccttttcataactgagtaccttcaaacctttgatgagattctgcctggtgtcatcttcttcaaactgggcataactgtcagtcagaagagtaaaggaaaagagtattatgagcgctatacccccgagcagggtcagtccgattataaggaatgtttttgcccgaagatccatacattactccttcggatcattcacccgttctgggggccatgggcatgtgccaggttacgagggctttgtgatcgtaataaatgaaccggaatatgtaccaaacatattcataatcggccgggcagtaattatatattgtctttcttcctggcctgaaccaacacaaagctgcatcccactttcatcatgcgacctgaaaaaatcaggtgagatgtcaaggtctgggcataagagacgaagtgcctggcgaatgtcttttaagaagagtgcagaactgcgttcttcaatgcattcttcagccgcctgattcatccagagaatagcatgatctgaatttatgattatcaccggatgagaagaatctgctatctgaacccacatggaaggagagagacctgccttttttccctctgttgtctggcgtatcctgtcacatagattcaaactgactttgatcgcacagtaaagaagactcggattgaccggttttatgagaaaaccaaatggcgtagaagacatagccttctcaaaaatcttcttctcatcatggccggtgacgaagataaccggtattgagaatatgttgaagagttgtgccgcagcttctatccctgacatgaccccgggaagatcaatgtccatgaggactacgtctggtttttccacggctacctgctcgagtacttgttcacccgagtttaccggggtatgaacaataaatccaccgtcgcgtaggatagagattaagacccgggctattatctcatcgtcctcgacaatcaggactgtattttcaggcatatatgataaacctcagggggttctcgccagacagcaggcgactcacgcatgtttccgttatcatagttggaataatcgatataaagtaattccgagatctcagtttcgcagaataggtattctacgaaatgcttaatattttagagatagagttaatataacagtggaaaaaggatatttttcagaatggattcccagatttatccaatatctgaaaatgaggaattattcgcagaaaactttgagcagttatgatctcaccatcaggcggtttggtcagttcatctggttgacccgatccttcaggggtgacctgtccaaaaagtgggagcacaaggaactgctcaggcttgagaccggagttgatgttagtgcatctgatatctccaggtacttagaattcctctctcttgatcggcagtaccatgctaccacatacaaccgtatcctctcctcactctcatctttttaccggtttcttctcatgcaggaggtggttgagacaaacccggtccctcgaattgaccgtccgaaggtaaaagagaaagaactgaagtatctgaaacacagccaggttatgcgtcttttgcagtccattcctgatgaacgagaccggctcatgataaggattatttatgcaaccggagtacgggtctctgaactttgcacgatgaatgttgaggatgtggactttgatgatcagatgatccgggtgctgggaaagggagggaaagtccggatggtctttgtggatgaagttactctgaatgagattgcaggccttatcggaaaccgactgtcaggtcccctcttccccggtcagggaggcaatcatatatccgtgagaaccgtgcagcttatctttaaaaaatacgcaccaccagggatcacaccacacaagatccggcatagttatgccagtgagctctatcggagatccagaaatctccgggttgtgcaggagaacctgggacatgcatctattaaaaccactgaagtatatttacataccgatgtggatgaacgccgtcaggtatatcgggagtttttcccgcttgttacttcaacccggagatcggtatctgaaaccggtacccggcaataccagggagaagaaccatgaggacaatacggacaacagatggaaaatggctacagatagatccaaaaacagatccttggatctttaaaacgccccattcctcagtcagagcatcgcttgattaccggcagggtgaggatctctatcttcgaactcttcctgacgggatacactattattatgtaatatcctggaccgactggcagcgcgagtctaaggaagcgtacagaaccctctccgaagaggaggcaaaggatttcctcataaaaaaagcacaatcagcaggcaaaatcggtcttgacccagatattttagatagaattgagaagtacttcccaggccttctgaaaaaacgcagataggcgatgcgggaatttctatattccagcagcacaaatatgtaaaggcaaggcctgtcctgctcttttcaactcccgtagtgtagaggtcaatcatatcggattttggttccgatgacgacggttcgaatccgtccgggagtatcttttttgctgactatccacagtatagcgactgattcatctgcacgatatcctctcaaaacattcggccattaactatatacgatatatgaagataatcacctatcagcaagagtgcacgggcatattatgataggcattcgatggatagattttgatcatattcctgatcgtctttcagggctgatcgatctctcatataatctctggtcctcatggcaccctgaagcatggctcctgtttaaaaatctgaaccgtcagggatggaaagaatccatacacaatccggtcagaatgcttcaggaactcccacctgaattacttgaagcagcggcatccaatattgactataccaatcactatgatgcggtcatcgcgaagtttcagcgatacatgctggcaaaaaaccaatggtttgatgaatattacccggaacaccagcatcataagatcgcatacttttctgcagaatacgggcttcagcactcactccccctatatgccgggggccttggattccttgccggagatcatctgaaagaatgtagtgacatagggataccacttgtggccgtcggattcatgtactctgacggatatctgcaccagcgaatcagaaatgacggctggcaggaggatgtcgaagaaaaacttgaccgtgataatgccccggtcaagcgggttcttggcagggatggtaaccagttaattcttcaggttccttttattgcaccccagattcattttgctctctggagagtggatatcggtcgtgttatcctctacctgattgatacggagatagagcagaatccaccgcatcttcgcaatatcagcagccgtctgtacagtagtatcaatgagatgagactacttcaggagatcgtccttggtattggggggactcatgccctgaaatcacttggggtaaaatattctgcagtccacctgaatgaaggtcatgcagcctttgctctggttgaactctatcgtcagaagatagaggaagggcttacttctgaagaagcattccatcatgtctataatacaacgctcttcaccactcatacacccgtccctgcaggccatgataaattccctcactggatgattgacaagtactttaatgcatactattccggaatgcatatgtcaagggaggattttctgaagaaaggtctgcatttcgaggatcccccggacacctttaacatggcagcgttctgtatgcgtatggctgcacatgcaaacggagtaagtgaaaagcatggggaagttgcaagacggatgtggcatttcctctggcctgaacacaaactagatgaagtccctataggttcggtaacgaacggggtgcacattcccacatggataaacccacgcctggttacgctcataaatcggtacatctcccccatctgcccggactggtttgaacatcatgataaggagtatgtatgggctctcattgaccgggtacctgatgcaaaactctgggaactccattatgcgctgaagataaaactcatcaaccggatattacaatttaaaaggcgcgattggatgaaataccaggcagactgtgcaaatgtggtggcaggtggtgctctgatagatcccaataccctgaccatcggatttgcacgccgcttctcgacatataaacgggctgaccttatcttccaggatcttgaccggctgaaaaagatcctgaataatccctggaaaccggtacagataatttttgccggaaaagcacatccggctgatgatgaaggaaaacggattttacagcggatctatcagtatgcacaacaaccagaatttggcggaagaattgcatttgttgaagactatggcgagcaggtagcaaagtacctggtgcagggagttgatgtctggatgaataacccggttcccccattagaagccagtggtacaagcggaatgaaagctgctgtcaatggtgttctcaacttctcaattgctgacggatggtggatagagggatataatggcaagaacggatggatattcggaaagagccataccaataatgatcggaactgggaggatgcgtctgaaatgtactccctccttgaaaatgagatagtcccactctattacgatactgatcttgatggaataccccataagtgggttgcgatgatgaaggagtcaatcaagagtaatgcaccccggttttcatcccgccggatggtaaaagaatacatgcataaatattacatatccattctttcctgtgcggaatgtaatgcatttgttgatgatagtacccctgaagggatatcacaataaattattattcagttttttctgaaacagaggatgactcctctgcatcactgattgccagctgatacatccagtcaagtagatcattacatgtttcgatggtacaatcctcatcacatgcgatgcagggaatcagttcatcaccggcaagaagacagtatggatctgcaggacccttacgggcaataagtctgaatgtcttaatgccatcctgccggtattcaacgcgttcaaccctgtttgaatccagaagtttctttacgattcgtgaacatttcctgctgtcaaccccaaggatcttccagagttcactctgcagtacaccttcaggtgaagaggcaatgatccgaaatgcatcctcgtctgttccggacatgtccacctttaagcaaccggtgcaattgacaaaatattgttaccacgaataacgagtgttccaagctcgcgacccttgtttttccctgatgtttcaatactctcttcaagatgcaggttcaggtactcatccactgccacaagccggccctgaaatgtccttccttcatcctctttcatttctacggaaatcaaagtatcaacaagagaatatactttcttgattgggaggacaatgctgctaaccatctgccttatataaggcttgcagccatattaaagattcctgataccgatatgaaaaaagtgttataagtttttgtagatctcctcaatcttttctataatacctttgcttccaatgtaaaccggagtcttctgatgatgtttttcaggaacgatattcagaatattccttcttccatctgttatacgtccgcctgcctgggtaatgataaatcccagggggtttgcttcaaataaaagccggaattttccattcgggctcttctcagatcccggatatgtgtaaatcccgccatagaccagtaactgatgacaatccgctacgaatgagccggaatatcggattttaaagccattctgatcaaaatactcgatgacttttagatgaggtaaaagccattcatttctcacaccgccggttccatattgcttcccttcagggactgagaagtggtccttaagcaggagataatgctcactctccggatcccatgcaaagctctgaaccccttttcctacggagactacaaggactgtaagtggtccaaagagggtgtaaaaagcagctcggagtttcgagcccggttgtagcactcctccgttctcataaataccaacgatagtgccaactgcaagatttgtcgagatgagcgaggaaccatcaagcgggtccatgaccatacagtactcacaccgtgagttttcaaaccggatgatatcagcctgttcctctgatgcaagttcccgcaccaggccggactctcctaccaccttaatcaggtgctcatctgcccatgtatccatctgggcctgcagttctccagaggcatttagggtatgttcatacatctgattatcaagaaatgcttttctgatagggtccatctgacgagagattaatcgtataagtgctatgaggtcaggttcacagccgcatgattccagatatttccgaaggaacaccatatataatcgtagagaaatatccgcatacttcatacatacgattttgcatccggcacgtggtgcagaccaccggttctattaagcatattaaaaataattcagtgcgacaagaagcagtaaatcggattgcgaacccggtttaaaatcgggaacgccacccaatccattctgggcgtccctacctgcacgtgcgtgtttagcaataaacgggtgcgaagctgcaggaacaacgtggtgattcccatagtctctttgggataagctgccagggaaaggtatcatggacaaacaaacgttgaaccgctgcaggatcgttaattatatcaggaggaaagagatttgcccctgtccccactgagggagaatcacggtatcagtagcttgaattatgctggtacgaatggacgaagctgattccggtctatgggcgggtcctaaaataccacaattatccgatttattgaacttggaaaacccaatacgctcctaaaaaaaaaaaaaaaaaaaattttaggtaagaaccttgtgagaggaaccacatgcgtagtgggagtaggaggctgcaaaacgcgaatgcccggctgtaatggctgtggataggggttcaaactttgccctgacctgaaagggtgccgacgtgcagctggtttttcacggcgaacaggatggtttcaatgaacgggataagttcaattacgcataaaagcgaggacatctcggacagaaaacttgcaaaacaatggaagaaatttccatttgctaaagcaagagattatgtaaagcgacttcagacacgtatcgcaaaagcagtgaagaacggccaatatcgacttgcaagacgactccagtatctgcttacacattcgttttatgcaaaaatgttggcagtacaacgagtaaccaaaaacagaggtaaaagaagtgcaggagtagatggggaaaaatggaccacccctgaacagaaaatgaaagcagcattaacgctttcggacaagggctatcgggcaaaacctctccggagaatctacatccctaaaccgcaatcgagtaaaatgcgacctctttcgattccaaccatgtatgaccgtgctatgcaagctttgtatgcaatggctcttatgccttgggctgagaccacagcagacaagacatcattcggattccgaatgaagcgaaatgcacaggatgctgcttcatacacttttcagtgcttaagcagaaagacttcaggtcaatggatattagaaggtgatatccgcgggtgcttcgataatttcgcacaccaatggatgcttgataacatccctcttgaccaaagaatccttaaccaattcctgaaagccggttatatttatgatggaatactctaccgtaacaagtcaggtacgccccaaggcggcttaatttcccccttattggctaacatggctcttgacggcatggaaagaatgttgaaagaacactttcccggaaataaggttcatctcatacggtttgcagatgattttctcgtaacggcagactcacaggaaacggcactccagtgcaaggaactcatcactgaatttcttcatgaacgagggcttgaactctctgaggaaaagaccaaaatcgttcatatcaacgaggggttcgatttcctgggctggaatttcagaaaattcaaaggcaaattcctgatacaaccttcgaagaaagctattgccgcaatcattgataaagtaagggtaatcattaagtcggcgaaggcctggaaacaggaagaccttatcaaagccctaaatcccgtaattaagggatgggcaatgtatcaccggacggtttctgcaagtatgacctttgggaaacttgactgggttgtccgaaatatgttgtggagatgggcaaagcgccgtcataataataaagggaagagatggattgccagaaaatactggcacccaacacttaccaaaaaacaggtctttagaacctctactcttactctcgaaaacttctccaacaccaaaattcaataccggaaattcataaaactggatgcaaatccgtttattgataccgagtattttgaacacagaaaaggagttttcctctcaaagcaaagatcgatacggatgttccttcattacgcccataaaagcgggtagtgaaaaacttgagcggattgcggtgaaaatcgcacggtccgttcttggaaggctgggttagggtaacctaacctggctattcgacgtattgggtaatactccgtgatccgtatcctgctccttgacgatgagccggcagttctcgatattacatctgcattcctcaatcggcaggaagggttccgggtcagaacaatagatagtgttaaaggagctctcatgctcctatccgagtatcccttcgatgtgatcgtggcagattatgaattgccggatcaggacgggatttcttttttaaaacaggtgcgaagttctcaaagttctatcccctttatcttcttcaccggtcgcggatccgaagacattgcaatagatgcattgaatgaaggtgccgacttttatcttaagaaaggtgatggcagcgtacaggtactgactaaacttgcaaggtatatacaaaaagctgtcgaaaaaagaagaaagcaggatgagatcatcctgaatgaacacaggtacagggagcttgccgagcaacagatggaatatgcccaatacattcaggcactccttgatgcaataccggctcctgttttcttccgggacacaaacggagtgtatcgtgactgtaacaaggcgtttgaagacctcattggtcatcggaaatattcgataatcggaaggtcggtgcatgacttttatccaaaagatcttgctgaccactaccggcatatggatgaactcataatcaagaacccttacatccagcagtatgagtatgtcattacggattcacaaggggaaattcatgatgtcctattttcaaaatctgcccttttgtctcatgagggatcggtgacaggtattatcggcgttatccttgatgtcagtgaaagaaaaaaacttgaacggatcatcattgagaatgaagagaagtatcgcacccttgctgacttcacctatgactgggaatcctggattagcccgacaggaacctatatttacacgtctccctcctgtgaacgtattaccggataccgtgctgaggaatttttacataacccgggccttgttctggaaattacgcatcctgatgaccggcagatggtagagagacattactcaaatgcaccactccgccatgatggcattcatcacatggactacaggataatcacgaaagacggacaggagcgatggatcagtcatttctgccagtcagtgtttcgtgacgacggtacatggctgggacggcgagagagcaaacgtgatatcacgtttagaaaagaagtcaccgcagcatatgaaaaggcgaacatgaaacttcacctgctctcaagtataacacggcatgatatcctgaatcaactgacggttttaagcggatatacagatctcttatccgattatgctgacaatccggatatccacgctatactgaaccggatgaacaggaccattgatactattaacaaccagatctcgttcaccagactctatcaagagattggagtgaacgcaccacaatggcatcatgttccgactctggtcaggcaggcggggaaaggatctcatattccctgtattgagataagtgagaatctttcagatattcatatcctggccgatcccctcatggaaaaagtgttctattgcctgcttgataattcagagcgacatgggaaacgggtatccagggcacatttttactgttaccatacggatggtgacatgactcttgtgtatgaggatgacggatatggaatcgctgctggaattaaggaaaagatctttgaacggggatttggaagcaataccgggtacggactctttcttgccagagagatcataaacatttccgggtattctatttttgaaacaggagagtccggagagggtgccaggtttcagatatctatcccgaaaggattatggagacatgaacccccaaaacatatgatttaatcattataatacctactatctgctatgcaaaagatgaaatgcagtatctgcggccatgtgtacgatccggtcatcggagataaggatgctcctgccggaactgattttcaaaacctgccacaagaatgggtatgccctgtctgtctagcggctaaaagactctttcgaccagtctgattcaggcgataaccttcactattttcccttttttcatgatcgataccttcccgccgctttcagacaccacaaacccgattgcatcggtaacatacgtgagcgcagcgacggatgaatgacgggtccccattcctttcggaagagatataattgatgtatcgacggtgatatatcgtcctgccgcctccagaagaccatttccgctcacaacaaatgcaccgtccaaaagcgcatattctttcaacatctctctgacatcaggaacagaaatatttctcatttcaggaggatggccggagaacggatttaatatcaactgacgggatcgcttcagtacttcttctgaatcgccgataaggaaggaggttccgattgtctttccttcccgcccttctctcccgatttcgatacatgcctgaagtaccgcatcaaacgcctctggtgagatatccgtaaaggaaaggatgcgatcacgccaggcccgtgttgatatcctctcttccccgctggatacctgttcggtcatatcagtgcccacacaaatgatgccggtcagggtattgtcagagtcatacaatccccggctggtccaggcaacccaaagatgatttccattctttttacaatgttcaaaaatatgcagggctgatgaggattcgtcagatacttcaagaaacaaagatgccggatttatcacattctgtattgccctgggtggaaaaagaactcctatactccttcctgtcaactcatccatctcatatccaaaacacctgaccgctgaaggattgataaaggtgataaacccatccggatcaagtctgatgaccagagtttctgcaagatacagttgttccctgcatttatactcagtctctctgagtgcagaatgaagagctgcataatcactgtggtcctcaatgaaccagattccgtctatcgggttatcctcattcaaagaatgcaccgtaatccgacatggcatctcctttccatcttttttccggacaatcccttcaagagatatatgaaagcactggtgacgaaagagttcatctcttaaagtctgtccattcatcagccatgtatcaggaggacgcccaagaatttcatgttcatcatacccggatcgttgaagaaaatccggattcacccgggtaacggttcctccccggacttccagacaggagagaggcatcgtactgatgatccggttatgatgatcatagtcttcccgaagggaacgctccacctttgcccgtccagatacctgccgaatcgatgcaaagatctgacgggatgcctcatactcctgaagagcaactgaaaaactcccctgtgatatatcaaaaaagatggcgttgttattctgtattatgtaaaagagaaaaccgggatgatatccgtgcaccatacactgacgctgccagttgacgacacggctcagatcatctcctgcggtgaatggtatgagaattatatcaggagtgatagcctgatatttttcctctccttcagcaatagatctgacctcccacaattcaatctgaaaattgtcagacagggaagactgtatggaggaagcgtccttacttttgtcgttgacaagaaggatttttaccataatgaacagaaccggaacccgctctttgttattacaaatatcttgctccgggatataagatgagctctctggctgaatatatattcaaaggatactgaacaaatattctcctcatgaaacgggtatctatgatcgtgtcagggcaggttcagggagtcgggttccggtattatgttcaggatattgcagaggacatgaggattaccgggtgggtgagaaacctcccggacgggacggtagagatcgatgctgaagggaaaacagacgttcttgagacatttatccggacaatctccaacaccaggcagggagctatacaggtgaggaatgttcatgttcaggagaaagaggtctgtggatattcgatctttactatcagaagagattgatagttttattggtttgaaagatgattgataattatgaaggttctctttatattttcaatactgatcgtcctggcggtctgccttgtttctccggtaagtgccgcctggtcgatcccgcatatgtctcctgacaccgaaaactggaacggatactggcagtttgaatatgatcccaacaatccgatctccgctgccatgtattgctgctggtgggagatggtgcacggccatctcagcaaatactctgatgcattaaatgaggagacgaacggaaccagttcatccagcggttcatcggtacagacgaaaagttactgtccggcatgtcacattgatgattcatttgccactcttgaagtggaccctgaactccaggccctgcatgatgaactgatggagacgaaaccatggctgaaggaagggaaaaacaagaaaaatggttcagaatcatcatccaataatacaacaacggccgtcatgttctttagtgaaccaacaaagatctgaattttcaatattttttccagatatccattagcccctaatttttgcgacagattcattgctctttaaaagatatattgtattgtgtcagatattaatcacaataatcaaatttcagatgataaaaggttctatgctggatttgggagaaggatcattgccgggattattgatggaattattataacactcatcgctggttttgctgcatactacctgggactgaccgaaggatggagaatgctcatcatgatgatccgacatgaggaggtcagaaccatggacgggattctggtcacatccgctcttcctggtcaggtagcaaccttcctcctggtcaccgtcattgtaatcccctggctctattatgcaattcttgagtcctctaaaaatcaggccacgttaggaaagatggcagcacgggcggttgttactgacctgcatggaaaccagataacctttgcccgggcatcactgcgacacttttcaaaatttatatcaataatcacctgtttcgcaggaatttttgcaatcgcatatacccgtcattcacagggttttcatgatattattgcagcttgcctggtgtattaccgaccggaaaaaattgagtgattatttaacagggaccacaggatattcccacgggttcgggatccttgaataatttatcccagttactatttctgtttccaagcgataacgaagagtcagggatttcagaggttgcattaatagaggatgtataccgctgaagggcagcccaatcctgtgccctgatgatatcacccaccgacgcataaccagagaggggatcgtttgtcccgggaactgcggatgttttgtttactgtggcatttgcagtcgtggtattattgccaagcccgcttgttgaattcatgaccatccccgctccagccagctcatccagaataccgttttttgtctcagtaaacaaactggtcggatcttcaccattgagaatcttatctccttcccattcaaatgatgttggcagtgatccaaaacccgggtttgttcctgctgaggaagcagcatttacaaatccaatgagaagaaaaatacccattattgcgcacgcaatgaatcgataatgaacctgcatatcaatcctatacatgttcacgatcgatactgcatatactttcttataccaccgaaaaaagaaaaattgacggttttcgcaattacagatggaagaggtatggcagggtgaatatcgccaccatcagaacgaccataccggtactgacaaagccgacgatatgatccgtatatcgtgcaagtcccctgcgggtcaggatccgttccgtcccttctttaaagataaaaccaccatcaagagggatcatggggagagcgttgaaaagaccggctgccaggttaataaatccactccagaatagaaggtgtatgagctcccaataccctggaaacggcacctgataatacccggtatcggtaacatcaaatcccagtatcttcatatactgcccttccatggtcgggttaaacggaacggaaagaagcatgaaaattccgaccggggagaacatgctctgcacggtatcgatgatcccctgaccgttgtagtaaaagacccccatgaaaccggattcacgactgccgagtgcttcaggccagggtgatacattgagcgaatagtattttcgttctccattatgatcaaatcccacgatgaccgtatctcccggacgggttgtattcagaatgtcagatacatcctgtgtggttgatactgattcgccattgactgtcctgataatggagggtgtcgggacatctgcctgtgctgcagagtaattctgataaagacccacaaccaccggctcttggattggcactgccatcccgatcatgctgaccatgagaccaaaactgataaggccaataaggatgttgttgatgattcccgccccatacatccgcatccgtggccagggagatgctttctttacctcctcatcatcaggctcaacaaaggcaccgatgggaattatcaggaacaacacgcccatactctttactgcaatctgttcaaccctgcagagaattgcatgaccaaactcatgaaccactaaagtcaggataaacgcaaaccagaccgcaaaggttgatgggacaaactcattgacaccaggaatgagaaagatattctgaggcttatgaagggatgtcggttcaggttttaattcgagggtcaggtttactgagaggaggagcatcacaaccatcgcaacggacacgatgatcaccatagctactccaatcgttccatatatacgtaaaaaaccggagaactttctgaagtagtcgaaaaatcctacttgatctgtcttcagcccgataatcggaccatacagtgtgatgaaacggggatagggattatatgtccggatatatgcaagaaggaggacatagccggcaatacagccgagcagaattagaagccaatccatgaatgtttacaggtggccctgacaagaagaaaaggttatggaacggatattaaaaatctagaagagaactctggtttttctgatggagaagattctttacggtctcccagcttgaacgcgcaatgaccgggggttgattatgatgcctgatgtacttcgtgagataggtaattgttaccgggtctgatggatagccactcccgatatcaccatattccttggagagttcttctatgatccggtcccgttcgactttcgctatgattgatgcggctgatactggtggaaaaagagaatcggctttatgacgggcgacgatggtgcaatcaggtggtgagaatgatgaaaccgtctcttcataccgttcttcgctcacatcacatgcatcaacatatgcgcatgtacagttcagaggaatgagagcctctgcatgagagcgggcgactatctcattcatggtcattgtccggcggagctcatctatgtcatgtgcagtccggataacgatcgaaaatgggaattgggctttaatatctgctgaaatcttttctcttgatttcgaggataattttttcgagtcggccactccaagtgcgatcagatcatccatatccgtacatccgaccgcggcgaccaccatgggacccagaacagatccttttccagcttcatcaacaccacagatcatcaattaaaatttgaaccgattgattgaaaaatctgatgtaagtaaaaatctgaccgcaatttcaaatgaaaggaacgtgcagtaacagttcaaaatgtttaaatatgcatcatgcatacttgtagaggcacaagcattcgcctcagtggctcagccggcagagcgcgtccttggtaaggacgaggtcgcgagttcaaatctcgcctgaggctttaatacccattttttaagccctgaattgttggatttaaatagcctttcattttctcaaaaatttttctttattataccttctgaatttcccgaaggttcttcataagaagaaagataaattattcgtattttttcgtaaattacagatgatgtcaggtcacaagttttgaatgaaaaaattagtcttctttgtatgcctgattgaaattttttttgatttttttaagcgtttcttattcttacggatatatctcttacttctagcccagaggaagtagaggcaaccttccagagcattttcctatcagatcagacttcatgtctttatcctaagttttgccatggattactcaattaaaatcagatcacatccgtcacagatatagattttccaagactagaacatttgaaaaatggaacacgaatttttgttgttcttgttccagttacaccgtctttaaaaaaaaagaagttcacccctttacaccataccttttgtatatcgtgcttctgtgacctacaccatccacaagaaggactattcttgatttgtcaagaatcatgatcaccctgtactctccaactctcaatcgatattgtgggggactgttcctatctttcatctttttaatatgcgataaaggatcatctctgattttatgcattgactgaacaatgttacgagagatttcaattgggagctttgtgagatcccgatctgctgcctttcaataatggatttcataaatcatgtaatgccatatttacgcattatctccgcttctgtcagtgtttcccctctttgaaattcttcaatggcttcttttgccctggatgcccacccttcgcaaaggctctcttcttcctgatgttcttcaagaagcattgcaataacatcttcatatgattcaccgggtttcattatctgatttaaccgtatttttagatcatctgacacagagatagactcacacaagtacgaacaattagggaagagatcagatgtaattcaaaaactacctgttatctcaatacggatatccaaaattctattacccaaatacacatcgtgaacgatatatccgtgcattgatatcaggtaataatgagaaattttccgaaatgcttcgtgatttttccgcaatgatatatgatcaataccatgatgaccttcagagtaaccttgaaagggttgttatccctgtgaaagataaaacccaaaagcggctcgaggatttcttttctgattaaaataattacttctcaacttcaaatacccgaaatcctatgttaccaaaacaataaatcacaaacagcctgatatccacctgtggatattcctcgataagccttttccatatccctgaacctgctgttcatgttcaggttggagttcaaaggtttcaggagtcttattaaaccgtgaaaattcagccccggaataatatttaaactcgattatccccggagtccggcaaaccgctcattgaacttacccacaaactcaagatctgatcttccctccggataggaacgctctacattccaggtaaaccagggagacaggtaccggctttataattcataaaaggttgtccagtaaaaattctcattaacctgcatgaagacggattcaggaagctgaccaatataaaggcgccagtaatcagaaaaaaaccaggggagatctggatgagaaacaaattctctcattctctgctcatacttttcctgccccaaatccatgcggaatatgtcattaaaatattccactcccatctccttcatggaaaggtcgggaattgttcatgcaaactcatccttcagggttagaatcccaagataaaagagggaaacggggtaaaatgccggttcaaaaaaatcatgcagaataaattgtgaagatagtgctttccgactatatgaaacgatttcatgaacggtaagccgactgacgaacccctcaagaataattatttctacccccctggacaaaagttgaataatctttgataacccaatcctctcaatttttcagaagggcatacgaaaactccggataaattaaaattatttcctcgccggctaatgtgctcttcttgtgctaattgaacgatgcacacttatgggaagaatttttttcttctcctgatctgtgacttcactcacaggaacaggaaaaagtaaattagggacagcacgacaagaaaacgttaatcggcttgttaaccaggttttgaacgagaaaagtcacaagatccagatctgttcgaaggtttttatcaaagagattatttgggattgatttgagttgtagaccgccggagtgctggtcttcacaaaatgggacctgttatacatattcttgataacttcatcaacctgatttcgcgtggatggatcaatgccataatcacggtataccacatccatgaggttatcgacttcctcctgggtagaaccaagcatgtgttcatagaccggatcgagtgtgatgaacgtggcaatattgtatgcagaacatacatcatcaatggcgacaggaagcactccagtgatgaaaatattggttacagaacggtttgtctgcctgctttgagaactttgtaataggtccggaggaaactatccccggatgtaatttcgtaatataaatgatcgtggtgtcgggttatgagttgattgaagaaattgtcatactcatctattatcacatagaccgggagggcacttgaggttcttacatggcccagccaggttgaaagattcagtgaggcgggatcatctatccggatatcaggcatattgggcaggtaatcagaataaagagtcgcagtcccaatcaatcgacagttacaataatggttaaaattttgttcgagttggtttttcgtgtcagatgaggatagttcagagaaatccagtttgaggactatgaaggagttatgcgatggagtcgggctcttgccaatccaagtggttccaaagagctcttcaaaccttgaggcctcacggatgtcataataatactggagcctcgagcagaacagggatttgccaaatcttctcggacggagaaaaaccgggtttttattgcttccagtttttcaatgaaatgggttttgtcaatgaaataacggctttcctgtattaattcagcataattcattattccatatggtatctgccgctgcatattgttctccggatatactattcgtgtaatctttttactatcatataattaaaaaggatgtcgtgttgaatgatcaaaaagattcagagatatttcgaacagacatatcaggagatctccgtatttcattatttgttcagggacagtgtaattcctatctcctgcttcgggtgttcagtatgtgacatcatcgatgagagatgtatatagaagagataccaatcgcgtggcatatcgacagaatataatgatctcaccagtggtggtaaaattctcttgttttttaaaaatagatatcattttgaattttgttagaaaacttggaaataaatcacaccctaatccaatattcaatcaattttcagttgtttatgtagcaaagtcctttgatattttcagtcaaaaaatatcagaaaatcgatgttaatataaagtgcctaaataggattgtgtcagaaaatatctttatttagataagagatgaggaatagaactacgatgaacaggtattcaggtgatttttattgaatgacacacatacaaaaactttcttatggtatcgatacatagaattcgtacgcactcaggaggtgtgatatgtacaaacgtgatgatgcagtatcaccggttatcggtgttatcctgatggtggcgatcaccgttattctcgctgcagtgattgcagctttcgtatttggtatggctgggaacgtccagagcacaaaaaatgtggcggctgtggcagagcaggtaaacgcaactgggattgttgttacgtatcatggtggaaaagaccatcctgatgtagctaatttatcaattggctttgcaggtgcatcaccaactatcgtaaaatcttatcccgatttgaaggttggagatgtgttccactcggtagctggcacatcaggtaaagaccgtgttgttgcaattgccaaatttaatgatggaaaagagcaggtaatactggatacaactgtataaccttactttttttcaattatattagctcaaatttactcatattatgagaatatcttaaaaaaataactcaaataaactaaattaaaaaaaatgtaaagattttttgctactatactcgcgagaaataattatgagacacgtaaattaattcaaaaaagggagcattaacatgtataatcataatgatgcagtatcaccggttatcggcgttatccttatggtggccatcacagttattctcgctgcagtgatagcagcattcgtatttggtatggctggaggtgttcatagtgcaaaaaatgttgcagctgttgctgaacaggttaactcaacaggaattgttgtgacatatcatggaggaaaagatgtgggatatgtaacgaatttgtcaattacatggccaggagctgcccccactatggttgcatccgcccctaatttgaaggttggccaatcgttccattcaatgactggaacatccggtaaagatcgtgttattgttattgcaagatttaacgatgaaaaagagcaagtaatacttgataccacagtctgaaagatattaagattgattttccatcttatcatttaaatattaaaacaatattgctccttacgattctcaatattctgtttagatctcccaatcctgacttattgaattaaaacacagatttatgaccaccaaacgtgaaaatgtacactattttaatacttcatggcaggttcagaaatatttctgattagatcatagtttcggtgaagttatctatataccctagaatttatatattccgctaaaattaatcacaatgtccatttgaacctaatcgcatttccgtaaaagttgaacagtgtgttctacttgaactgaacactctttccagcattattgattagtttaaacatccttatatgtgagcattgaagtatgcatgattacagggatatttgtgatatgaatcccagaaatcatgtactgctatcccaaaataatgtggaagaactccaagagcttcgattcctgcatgtccgcgacttccaaatatcccgtataatgtcagtagtttggttgaggcaacatggagccaggatttctttttacccactttcatgcccgtttcatctgtatggacgacgggtgattcaatcagcaattctctaattttatccgtgaatccctcaagattccctccaacccgttcaaccatattgataacagtacctggactgatcgaacatccatgaagatctgaaaggatatgtgtgagcctttttactgggatcaattgataaacagagagataagcaacatatgcagttaaacgaacgccgtattggactttttgagtgacgtgtctcggaaactctccatttgtgacagtatggcaatcagggcagtggtaagaaaagagacggtgagcaatccataggatagttgttggagggagttcagcttcctgtctttcatcaaggaattgtaaaagcttagtttgaactgtggcaccgcatcttgaacaaacttttggagcatgttctattattatgtcgggcttttcagctggcgataatgtggttccgatatgcccaatctgccctccagggttttttccactccgaacacgactattcggtattttcttgtgatttaatggattctttgatgggggaatgctactattcgaactattgaggttggaacgattttctaattctcgattccggttttctagttcatggttacgttctcgtaataattgaattattgatattaaacgagcgatgagttcgataatgattggatgagattttcggatatgatcctgttcctcatcactaaattccatattgaaatctgaataatagatttgtgctcatattactaagaattttcggccaattaaggacgaattagttgttgagaatcaaatgtaatttattttatttctagtatggctggatagtaacaagtattttatgaatgattccatcccaaacgagccttacttaatgaaagattaaaaacgaaacataaccagagtaaatgatcctggtttaattaacttattgttttaactctccccctcaggaaatagagtatcgcatttttcgaagattcaatattcctcctgcatgagatgaaacattcatgtgccgcaccagtttgacccctccccataccctgcattcatgtgatttttaggcatcacaagaaaaccaagaacaactcctattcaaatcttttccaggagtaacccgagtacaccttatctcaatcgtaaccgacagatacggtttttaaaaaccattaccggatttttactgaccctactgttttatgccataaacaccatagaaaaccctgatggaggatgagaatagtttaacgatttttttcctgtatcaagtttccttcagagagtgcatacaatacaaatattcgacaaatataaatatatataaattaatcatttctgacccccttattgaaataaaaatctgatggaaaataccctcttaatacctttatatcaaagaatttatgcagaccacttcaagattaaaaaatttcctcaaatcgggcatatttttctattattctcctaattcagacactcatatcacaacgctattggatgataaattgtacccccttaatttatatgtccaacccatgatatgcgaatagcatttgtctattgaaacattttaaataccgaaatttacaagtattttgaaatttatatcaaaatttgagttcaaaattgatttttcagcgaaaaatatcacataacgagagaaaaaatataccagaccatagaatttcagatttttctttcataagaacggcaatgaaacaaatttttttcctatatctgtatggtatgaggatattatagtgcccagcaaaacgtattggaataatcggtttgaaaaaaagattattccaagacgtgcattcgaattgcacttcataggaataagtaaaatttctgaattatttcagaaaattttgcattatactataatatccaccggagtgatagtgatagcaggatattcaataatttggtgctggccgattagatcttcagcttttttatctcttctgctgataatccggtagcttttacaatatactcatcttccagccctaatttaatgagatttcgggcaatatttcgtgcctcttctaacttacctttctcgattcctttctcgattcctttctcgattcctttctcgattccctcctctttccctttctcaatgccctcttcaaccccaatcgtataccattttttactgatcttctgagtaacgctctctatcaaattttccaccctctccttgctcttggtatcccggatatatttctgatgcaactgtgtatataactccattgtcgctgagagaataatatcctttgtttgctcatccattactcctttttcttcaaacgttccggtgattgttgtaatctgctcaatgtcctgtaacacatcctgaacaattgcatcaaattcttcctggttcaggtttttccgtctgcagatatgatcaaacctcttcctatacttcacgagaaccagcggaattaccagatagagatccatttcgccaagttcacatgcggagtatgcatacaacctgaaaaccggaacagtataatgtacttccgattcattcggaaagatgatttttactttcaggtcatcccgaattcgtttgtgctcctcaagatatatcacaacctgatgagggatcgatataatccgggaatcatcatcatccatctgtgaccgtgatgcaccgatgagatatccgtattttaccatacgtaaatccatcatcccatcatgttcagtctggatttcaatgtgaaagaggggatcaggaccggttccatcatgcacggcaaggacaatgtcgggaagatgacgggaaaagccagggtgggatatgaattctgatgagacacggatgatttctgcggtttctttgtttatttgaatggaaaaaatccggcagataaaatcaagtaatgcctgatcagatgcatcaaataagaacttggcagtctcatcgatcagagcacgggagttttcatggctcacctgaatgagtgtgttcagggggcatttgaaatttgtgaaatagtggcgaaattatgccggaatgaatcatcaataaatgaaggaattatgatggaaagggaacagaactttaatttacaacgcttcccgtttgatagtatcgagctcatctggagtaaggcctgtggctttcagaattacttcatcagcagttccgatcattaacagattttttgctacgatcttaacaccttcggcaataccttcacgttttccttctttaatcccgatcatatgccattttttactgatcttctgtgtgacgctctctatcatattctctaccctctccttactcttactatcacggatatatttctgatgcagctgtgtatataactcaattgtcgctgagagaataatatcctttgttttctcatccattacaccattttcttcatacgttcctgtaattgttgtgatctgttcaatgtcctgcaatacatcctgaacaagtgcatcaaactcttcctggttcaggtttttccgtctgcagattatatcaaacctctttctgtactttaccagaaccagcggaattaccagatagagatccatttcgctaagttcatatgctgagtatgcatacaacctgaaaaccggaacaatataatctacttcagattcatcagggaaaatgatctttactttcagttcatcacgtatccgcttatgctcctcaaggtatatcacaacctgatgtgggattgagataatccgggtatcattatcatccatctctgaccgtgacgcaccgatgaggtatccgtatttcaccattcggagatccatcatcccgtcatgttcagtctggatttcgatgtgaaagaggggatcaggaccggttttgtcatgcacggcaaggacgatgtcggggagatggcgggaaaagccagggtgagagatgtattctgaagagacacgggtgatttctgcagttgctttgtctatgtgaatcgaaaaaatcctgctgataaaatcgattattgcatgatctggtgcatcaaataagaatttggcagtctcatctattgcagcacgggagttatcttgactcacccgaatgagtatgttcagggggcatttgaaatttgtgaaatagtggcgaaattatgccggaatgaatcatcaataaatgaaggaattataatggaaagggaacagaattttaatttacaacgcttcccgtttgatagtatcgagctcatctggagtaaggcctgtggctttcagaattacttcatctgaggttccgatcattaacagattttttgctacgatcttaacaccttcggcaataccttcacgttttccttcttgtcttccttcttgtcttccttcctgccttccctcctcaatcccgatcatatgccattttttactaatcttctgtgtgacgctttctatcatattctccaccctctccttactcttcctatcacggatatatttctgatgcaactgtgtatataactcaattgtcgctgagagaataatatcctttgttttctcatccattacacctttttcttcataccttcctgtaattgtggtgatctgttcaatgtcctgcaatacatcctgaacaagtgcatcaaactcttcctggttcaggtttttccgtctgcagattatatcaaacctctttctgtacttcacaagtatcagcggaattaccagatagagatccatttcgctaagttcatatgctgagtatgcatacaacctgaaaaccggaacaatataatctacttcagattcatcgggaaaaatgatctttactttcagttcatcacgtatcctcctatgctcctcaaggtatatcacaacctgatgtgggattgagataatccgggtatcatcctcatccatctgtgaccgtgacgcaccgatgaggtatccgtatttcaccattcgaagatccatcatcccgtcatgttcagtctggatttcgatgtgaaagaggggatcaggaacggttttgtcatgcacggcaaggacgatgtcggggagatggcgggaaaagccagggtgggatatgtattctgaagaggcacgggtgatttctgcagttgctttgtctatgtgaatcgaaaaaatccggctgataaaatcgattattgcatgatctggtgcattaaataagaacttggcagtctcatctattgcagcacgggagttatctttactcacccgaatgagtctgttcagggggcatttgaaatttgtaaaatggtggcgaaattacgccggaatgaatcatcaataaatgaaggaattgtgaaaaaaaaggaacataactttaatttacaacgcttcccgtttgatagtatcaagctcatctggagtaaggcctgtggctttcagaattacttcatctgcggttccgatcattaacagattttttgctacgatcttaacaccttcagcaatgccttcttctttacctttctcgattcctttctgaatgccctcctcaatcccgatcatatgccattttttactgatcttctgtgtgacgctttctatcatattctccaccctctccttactcttcctatcacggatatatttctgatgcaactgtgtatataactcaattgtcgctgatagaataatatcctttgttttctcatccattacacctttttcttcaaagttaccggtaattgtggtgatctgttcaatgtcctgcaatacatcctgaacaagtgcatcaaactcttcctggttcaggtttttccgtctgcagattatatcaaacctctttctgtacttcacaagtatcagcggaattaccagatagagatccatttcgctaagttcatatgctgagtatgcatacaacctgaaaaccggaacaatataatctacttcagattcatcgggaaaaatgatctttactttcagttcatcacgtatccgcttatgctcctcaaggtatatcacaacctgatgtgggattgagataatccgagtatcattttcatccatttgtgaccgtgacgcaccgatgaggtatccgtatttcaccattcgaagatccatcatcccgtcatgttcagtctggatttcgatgtgaaagaggggctcaggaccggttttgtcatgcacggaaaggacgatgtcggggagatggcgggaaaagccagggtgggatatgtattctgaagaggcacgggtgatttctgcagttgctttgtctatgtgaatcgaaaaaatcctgctgataaaatcgattattgcatgatctggtgcatcaaataagaacttggcagtctcatctattgcagcacgggagttatctttactcacccgaatgagtctgttcagggggcatttgaaatttgtgaaatggtggtgaaattacgccggaatgaattatgatggaaaaacccgggtaggaggtctaatttacaacgcttcccgtttgatagtatcgagctcatctggagtaaggcctgtggctttcagaattacttcatcagcagttccgatcattaacagattttttgctacgatcttaacaccttcggcaataccttcacgttttccttcttgtcttccttcttgtcttccttcctgccttccctcctcaatcccgatcatatgccattttttactgatcttctgtgtgacgctttctatcatattctctaccctctccttactcttcctatcacgtatatatttctgatgcagctgtgtatataactcaattgtcgctgagagaataatatcctttgttttctcatccattacacctttttcttcataagttcctgtaattgttgtgatctgttcaatgtcctgcaatacatcctgaacaagtgcatcaaactcttcctggttcaggtttttccgtctgcagattatatcaaacctctttctgtacttcacaagtatcagcggaattaccagatagagatccatttcgctaagttcatatgctgagtatgcatacaacctgaaaaccggaatattataatctacttcagattcatcgggaaaaatgatctttactttcagttcatcacgtatccgcttatgctcctcaaggtatatcacaacctgatgtgggattgagataatccgggtatcattttcatccatctgtgaccgtgacgcaccgatgaggtatccgtatttcaccattcgaaggtccatcatcccgtcatgttcagtctggatttcgatgtgaaagaggggctcaggaccggttttgtcatgcacggaaaggacgatgtcggggagatggcgggaaaagccagggtgggatatgtattctgaagaggcacgggtgatttctgcagttgctttgtctatgtgaatcgaaaaaatccggctgataaaatcgattattgcatgatctggtgcatcaaataagaacttggcagtctcatctattgcagcacgggagttatctttactcacccgaatgagtctgttcagggggcatttgaaatttgtaaaatggtggcgaaattacgccggaatgaatcatcaataaatgaaggaattgtgatgggaaaaacccgggtaggaggtctaatttacaacgcttcccgtttgatagtatcaagctcatctggagtaaggcctgtggctttcagaattacttcatcagcggttccgatcattaacagattttttgctacgatcttaacaccttcagcaatgccttcttctttacctttctcgattcctttctcgattcctttctgaatgccctcctcaatcccgatcatatgccattttttactgatcttctgtgtgacgctttctatcatattctccaccctctccttactcttcctatcacggatatatttctgatgcaactgtgtatataactcaattgtcgctgagagaataatatcctttgttttctcatccattacaccattttcttcatacgttcctgtaattgtggtgatctgttcaatgtcctgcaatacatcctgaacaagtgcatcaaactcttcctgattcaggtttttccgtctgcagattatatcaaacctctttctgtacttcacaagtatcagcggaattaccagatagagatccatttcgctaagttcatatgctgagtatgcatacaacctgaaaaccggaacaatataatctacatcagattcatcagggaaaatgatctttactttcagttcatcacgtatccgcttatgctcctcaaggtatatcacaacctgatgtgggattgagataatccgggtatcatcctcatccatctgtgaccgtgacgcaccgatgaggtatccgtatttcaccattcggagatccatcatcccgtcatgttcagtctggatttcgatatgaaagaggggatcaggaccggttttgtcatgcacggaaaggacgatgtcggggagatggcgggaaaaaccagggtgggatatgtattctgaagagacacggatgatttctgcagttgctttgtctatgtgaatcgaaaaaatcctgctgataaaatcgattattgcatgatctggtgcatcaaataagaacttggcagtctcatctattgcagcacgggagttatctttactcacccgaatgagtctgttcagggggcatttgaaatttgtgaaatggtggtgaaattacgccggaatgaattatcaaaaaatgaaggaattgtgataaaaaaaggaacagaactttaatttacaacgcttcccgtttgatagtatcgagctcatctggtgtaaggcctgtggctttcagaattacttcatcagcagttccgatcattaacagattttttgctacaatcttaacaccttcggcaataccttcacgttttccttcttgtctcccctccttaatcccgatcatatgccattttttactgatcttctgtgtgacgctctctatcatattctctaccctctccttactcttcctatcacggatatatttctgatgcaactgtgtatataactcaattgtcgctgagagaataatatcctttgttttctcatccattacaccattttcttcatacgttcctgtaattgtggtgatctgttcaatgtcctgcaatacatcctgaacaagtgcatcaaactcttcctggttcaggtttttccgtctgcagattatatcaaacctctttctgtacttcacaagtatcagcggaattaccagatagagatccatttcgctaagttcatatgctgagtatgcatacaacctgaaaaccggaacaatataacctacttcagattcatcagggaaaatgatctttactttcagttcatcacgtatcctcctatgctcctcaaggtatatcacaacctgatgtgggattgagataattcgggtatcattttcatccatctgtgaccgtgacgcaccgatgaggtatccgtatttcaccattcggagatccatcatcccgtcatgttcagtctggatttcgatgtgaaagaggggcttaggatcggttttgtcatgcacggcaaggacgatgtcggggagatggcgggaaaagccagggtgggatatgtattctgaagagacacgggtgatttctgcagttgctttgtctatgtgaatcgaaaaaatcctgctgataaaatcgattattgcatgatctgatgcatcaaataagaacttggcagtctcatctattgcagcacgggaattatcttgactcacccgaatgagtatgttcaggggacatttgaaatttatgggatcgtgaggatttatacaagaataaatattaaagtaattgagataaatactcacactaaatgagaagaaagggagagattatatcccaattttaccagattatatattatatccgaaaacattctttcatcatgtatcaggctttataacgatgttcagaatatagccgatacccctccatccctttgaaaacaaattcatccaaatacttttccatatattttcggttcagcatatttgcaggtattgggcaggatatatctccgtcatatttctgataaatatacaggacaacttcatctccaggtttgatgtacccgtttttcagatcgattacgatactctctttatatgagaaatataatcccttgcacccggagccacctatgtatttgacaccataatggtgagagggaataaaattatggccgttaagggaataaatgcatgcaagcaactcctcatcattgacaaatatttttgcccggagtttatcattttcaagatcttccttcccgaatgaacgtatggttacctgactttcaaattttgtcccatggtttactccaatgatttgaataattggaggtgccagtgagtcatcacccggaaaaaagtttaagaatcccaaaaggtacgcaagaagcagaaccccggcaataattacaattgcaaccaggagaatatttccatgagaggatgaatctgcttcatcatatcgcattttaagccgtattagtttcattttaacaggataatttcttgatatttcttctcagtgggttttcataatttgagagggtatgattttataccaaccctgcatcgccatcttgcaatattgaagagaatttaaatcattcaacaatcaaatccagttttttactggaagtactatttctgaacatgatctggtgagataccaaataagtaccaggagatgtatacgaatgattcattggtctaccgtaagtaattgatccatcgccataactccaggattcccacaaagaatccggataataatctgatgtaaacatgatctcccgtgtgccattttctgttacactactcacattgaattcagcccaatacggggagatttttcggtctgatatgagcctgatagtatgatctgattgcactgactgaagggtccaggaaatattcaccggaattgtatcattatcaacctgaagatatgaaggtgtgaaatccttatgcgacacgaattcgaatggaacatctgatcctcgtttcacccgtattgttccattcggcataattatcccaccatattcagcggttacatacaaattgcagaattccggctctttcgtaggaagaggggttggaatgacggttggaaatggtgttggatgaggatcatttttagaaaaatctacaaatacgctgtgattggtaataatatcagttaataataattcgttcagaggtccctgaagtgtggtatcaagatagacattttgaattctgtatccagaatcctgttgaatatgaatcctgagatcagaatgaacaggtacctgaatgagaccattcgggattgtggaaccaccctggcccgctgttatatgaatatcatgtttttgctttgatggttcgcatatctgaaagataattttctcatctgacacctggttatcaggattgacaacatgaaccagatatgaaccaaccggtacatgggacaggtcaaaagaaccctgaacacacgtcccgtccgcaactgtgattgtgggactgatatttaccaaggtaatggtatgtgatatgtccgtaatatgaatgctacacccatcggtaaagccggaaccggttacagacaacgacagactcgagtcacctgctatcccagaagagggatgaaccgaataaactacaggaacaggaagtctgacggtgaagattacatcatcaacactctcctgaccatcagggttctcaacatacacaccatacgaaccagcaccggctccggttaaatcaaataaaccagtaaccacctgaccttcatcagacacaactgtagaactcaaattggtgatcgaagaaccactcaccagatcacgaagatgaatagaacacccatcggtgaaaccggaaccagttacagacaaagaaagacttgaatcaccaatcagaccaaaagggggattgactgaaactgccgtaggagcagcgtgtttcaccgtgaatgtaatttcatcatcactctcctgaccatcagggttctcaacatacacaccatacgaacctgcactgactccggttaaatcaaataaaccattaaccacctgaccttcatcagacacaactgtagaactatagttggtgatcgacgaaccactcaccagatcacgaagatgaatacgacacccatcggtgaaaccggaaccggttacagacaaagaaagacttgaatcaccaatcagaccaaaaagaggattgactgaaactgctgtaggagcggcgtgtttcaccgtgaatgtaatttcatcaacactctcctgaccatcagggttctcaacatacacaccatacgaaccagcaccggctccggttaaatcaaataaaccagtaaccacctgaccttcatcagacacaactgtagaactatagttggtgatcgacgaaccactcacaagatcacgaagatgaatacgacacccatcagtgaaaccggaaccggttaccgaaatatccaaagcaccatcgccaattcttccaatatttgggttaatcccggtaaccatcggaggaggaccatacacaacaaaatacacctcttcttgggatatctggtcatcagtattcctgactcgtaccaggtatcggtccccaccgtccaaccgtccggtaaaagaacactgaattgaattcaatagaacagagcttacagtcgcagggaaaatttcacctcccttgctttccatctctaccgtacatccggacatgaatccgcttcctgttatcatacaagaaaacggtccttcccccagatgacctatacccggagatatactaacaacatgaggggaggttgcaaataaaactttaaactgcatttgagacgcataacttgcaggtttcgtggttttgatgacaattgtatatgggccgggttctatagaaattaatgaaaaggtaacagcaagttctgtgtctgatctcaccactatcttcgagcaggtatagcgctttgttaccgattgatccagcagtatatttgagatctgctctgattgaaatccggttccatgaagggtaattataacctgaccagtatttatcgcggactccgggctgaaggaagtaataaccatctccgcagtaaccgaattgatgaaagaaagccataaaacaatcagaattataaatagctgaagacatctacgattcactttcatttaatgagccgagatgataggaaatgtaagaatatgaatctctcgattttatattaatgatagaatgtcaggattaatatattatggcagaggaaaaattaaaaaaattatcccaactcaaaggtagtgacaccaaaaatttcattgagaggtaaagcaggagccattttcgtatacatccgggctgtcccgaatacctccaccattgatctttcttgtgccatgcggaccgctgcagtattcggttcaggagtatcgtaaaatattacctccccaggaataggtgcagtaagcccttcaaatatctcattggcaatatccggagtatctgcgaaaatggggccaattttgtacccctcataacactttcgaatcactccgtacccggatattttctcatctttatccagttttacaagagcggttgcttctggctgatgaatccatttttcaagaaatactcttctctctaccggaaaatgagcagtgtcatatgccagtagctcttcaaagggaacatcctgtgaagatataaggtcgggttgctctatcccagctgcaaccccctgccatctgatattccggtacgcaaaccgaagacccatcttctcagtatacttatcctgcatctcatacaccccgtcgacaccgaaatttctatctcctgcatgagcgaaaatggcggaacaaatatcccatccgattccatgatgccggcagttatcctttacaatgtaaaacccaccaaaacagaaagtttcatcataatttgtcgctaccccgaccccgataacttcaccatcataatctgcacagaaccagccggagggatccacctggtagtgacatgctccatcatgaagaccagggttccaaccctcttcccgtgcccattcgatgggaatattcacctcatcttctcgtaaattcctgatcacatatgaaactctcataattatatacggataacaatgatgaaataggtattaaaaccggtggattcaatttgatctgcccatcctcttcaactcccaagaatactattctatgctggcaggttcaatgcaccagtaccaggatgtgacaagcatgatacatgacctgatcctcgttattcataacttccttgtgccaataatattcataattaacatcatttttgctattaccgtcgtatttattgagcggaaaaaccccacaaccacaattgcatggctgatggcccttctgcttctccctgtcatcggatttgtgctttatctcttcataggacagagtttttaccgggatcggatgtttcatgtgaagaaagaagatgatgatgaattgactcaaattatcgagtcacaaaaaaaagagctgtttgtacattcagtcccagctacacatcccatttctgattcatataagcgaatgatgttgatgctcatggagagcaataaggcaccggtaacaacaagcaataatgtgagggtttttgttgatgggaatgaaaaattcaaagcacttattgaggctatacagggtgccaaagatcacatccacatggagtattacatcctgaaggatgatggaatcggaaatgaagtctttgctgcacttaccgaacgggccagggcaggagttaccgtcaggttccttggagacggacttgggtcagcagggcctcggaaatcattctatgaaccatatctgaatgcaggaggaaaactggcgttcttctttccatcactgatgaacatctctcatccacgtctgaactaccggaatcaccgaaagatagcaattattgatggaaaagtaggattcattgggggatttaatatcggtgatgattatctgagcagagtcccggaatgggcaccctggcgggacacagcagttcaggttaccggtcatgcagttcttgccatgcagatacggttcttccttgactggaattatgcagcgaaagaggataaggtggaatatgctgcacgatatttcccggatgagggagcaatggaagatgcatggcttccagtacagatcgtatcaggtgggccggacacctattggaacccgatcaaagaatcatatctgaaactgattaccctggcatcagaatcggtgtacattcagacaccctatttcataccggatgagagtattatggatgctcttcggatggcggctctttcaggaattgatgtcaggatcatgatgccggcaaagcctgatcatatgttcgtatactgggcagggtattcttacattgaacaacttctggatgcaggagtcagggcatatacctatgataccgggtttattcatgcaaaaacgatagttgttgatgaggctgctgcatcggtaggaagtgcaaactgggatgttagaagtttcagactgaactttgaaacaaatgccatcatgtatgatcataaaattgcacgggaattaaaagaatactttttggcagatctcaatgtctgttcagaactcacagcggaacggtttgcaaacatgccaaaaaagataaaattaaaactatcgatatcacgactcttctcaccgctcctctgatttttcctctttttcaccagagagattttcgcaaaatctacctctgcatgaagatattcggtgagacattcttcttttatgcacagaataatgtgcaagaagccgtgtggctgaataggggacaaagctccaggcaataacaccggccgtcgctccttttgcaaggtaactacccggtttcccgataactatgttctttctttttcgtatgccgtccaggaactcatcggttgagtcagcttgtacagcggtaaccacattaccaacatctgaaaggatgtgagcatcagacccgccggtaaagggaatgatatggttttgggcataggttatcgctttctggttcagacttcttatcatgcccccacatatcacctcaatgccatcaatatgacttaaaacactgggaatcatttttttctccacgcatttgagaaccccacgatttatgccataatagccgtacggatgagcagcaatcctcaggcagtcaaatggttcagcaagatgcagacattccatgaccggcagattttggagaagacccggactgtattccacccttttttgagagaaaatcttaaagaaatcctccatatcaccggaagaataaaaataaaaaagcagatgggggccctcctcagtttcaagctcaatgccaggaattaccaggacatcagacgagtgggatagtgcatcaagagacccgctgatctcattatgatcggtgattgcaactccaatgttcctttttttagcatacgtgagaaggtcagatatcttcgtcattccatcagaatgattcgtatgcaggtgcatgtcaaccgggtaatagccctctgaaatcaggtgagagatgtcaggtgtacaacaccggattacatccccctgtacataattgttcatgatgaaatacccttgatagatctgaatacctgaaattcagctgttttattacctttattattacacatattcccccatatagagttcctgggtttttatccatggagtcacgaaaatcagaataatcggagacagaatactacaaacagccagattcactaaaaaccacccaatcatagtcatcataatctgattgatctcaattatgcccccatatgcaagcgtatacgaaccccagaccgccccggcaatattgtttatcatgactccaaaaatgaagaaaatcataagatcacgcctggttgaaagagccggatctgcatgaaagtatcggaatgccacatatgggatgagtgcctgccataaatcagcaaaagaccagtataaggagacatcaaccggaagaccacttaggactcctgcaccaataacacaaccggtatatgcagccagaacaccccatattccaaaccagagggcaaaaactatcatgaaagcgacaatcaggtaaaatgatgagactccggtcactatcggatatgaaaagacaaaatatttggctccgagtgagttgatacagacaagcaggaaaaagagagataggtaaataataaaagggggacgggtgaatgaatcgacaggatagagccgtactgctggtttcacagaatagtaattatgtaagaagcgaatataaacaattaccggctattcatactcaggagagcaatattaatgcaggtgataccagaaaaatgggaaaacaatccattatatggcgcatttttcatatccatcctgtctgctctcattctgcttccctactggtggctggcagtgcaatggtcagccactctgattcatgattcacctacccggtttgcctttacttcaacgacctttctccttgttctggcaattattgatagtgcctttcttatcaggtattatcagattagacagaagaatcaactcgcctcagcaatacttgagattcacaaaggggcagaaaattaccggctgctgattgaaaatgctccatttccaatcactattacaaaattagatgataataccatccttgtcatgaataaaagagcagtcgaacttttttctgttgatccatcagagagaatcggaaacccggttagttttcagttcatcggacctgatgaccagaagcggataaatgaaattcttgccagcaaaaaccatgtgtcgggatatgaaattacctttcttaaggaaacaggagatcgggtttacatctccctctccgcagatataatcgattatatgggagaaaaagcagtttttgctgcgtttgtagatatttcagaacgtgttgctctggaacaggagattatcaggagggaagagaagttctctgttgtttttcacgaagtgccaaacccgctcatgatcctatcggaaaatgataccataattgatgtgaatcatgggtttgaacagtttttccacatgagaaaagaggatctcatttcactctcaattctggaagtgaactttcttacagaccttgctcttaagaaacggccaagagagtttgaagatcagaatacatgggagtatgaagcaagccttcctaacggtgaaaaaaaatttgtcatgcttcattaccggaccattcaatatggtgaaagtctgcatacccttcttcttattcaggatattgatgcaataaaacgaggacaaaatgcattgacacaggcgaacaatcaattgctcatactgaacagtgtcacccgccatgatattttaaacagagttatggccgtcatctcttattgtgagctgctgcgacactccatacaaaaggaaccagatattacctggctgaataatatcgaaaaagccggagacgatattcagacacttatcgaattcacccgccagtaccaggatcttgggattcatccgccggtgtggcagcggattgacagaattatgaaaaagaaggaaattcaaacgttcctgaccaatatttcagtatctctgcctgatgaatcctatgaagtatatgctgatcctatgtttggaaaagtcctgtataatctcattgaaaattctatccgtcatggagagaaggtgacacagattgctttgtcatatgaaaaaagaaattcagatctcattttgcgatacaccgacaatggaacaggaatagcagatgaagacaagagtaaaattttcacaaaaggttttgggaagaatacaggattaggcctttttctgatacgggagattcttagcctgaccgggatatcaattaccgaacatgggatacacggaacaggagttatctttgatatgctcatcccggcaggttcctatcgaatttctgctaccaataaggatcagtcttatatatgactttactatcctccattagggtatcagatcggacatggatgttgacatttgatgacgatatttcggtcatgatcatcataggaacacagcatactgttctttgtgatacacatttaggccctgattctattcaggagataaatggctttcttgcatcaattgatcatccagacaacctgttcatttttaactcccattctgattgggatcatatctggggtaattgtgcatttccggattcaattattgcagcacatacaacctgtcggaaacgtatgagcgaacggagtgccttcgatctcgttcgaaacgggggaaaaacaagaggaccggtgcagattctcctccccaatcttacatttgattccaggctgtgtcttgaaaatgatgatattgaattcatgcatgctcccggtcataccattgactcatccgtctgtcttgatcgtaagggagaaatcctctatgtaggagacctggttgaagatcccataccctatatcgattatgaccggatcgatggatatataaaaactcttgaatcgcttgtatcatcatctatacaagtcttcatctcatcacattcggggataattacccgggacctcatcagatcgaatatctcttatctcaatgcagttctcaccgggaaggaggttgatatgagttcattcggagtatataaagcagttcatcaggcaaatctcaatacactcatcattttcagatatgaggcactagcacgggagatactcggggatacattttcatttgagacattctggtccggcattccagaccaggaaggatcagatcaggagtcgctggagaattttctaaatgaatatctccatgaaatccgaaaaagaaagggattcccgtagcttgtttatttccatattttggttattcctgcagagataatttcatcggtatgtacctcatcatctttgattgataggagttcaactatgccattcagtatctgctgggtcattacgagatgataatgtaccgggtgatcggtaagcagtccttccccgatagcccgggtatagatatcatgcatccatttgaattcgtcaaatgcctggctctggactctctcactgatgttgggtgaatgatgaaactgcattaaaaaccgtgctttttctggattctcaatggcccagtgtatataccggataaatccgcgttcaagaagggttttcaccggcagggaagcatcatcagtgcccctgacaacatcacccatctctttttttatcgtgagatataactcatcaatgatcgtatttttgtcaggaaaataatggaataatgtcccggtcgatatctgtgcttctttacttatctgtgatgtcggtgttgcatgaaacccctgggttgtgaagagatggagagcagcctttaggatacgttctcgtttatcagagccagagacattcttctggtcagatgaatcgtattgagccattcacaacaccaaaacgatgggattagtcttcatcattaacctgtgaagaaaacatccgcttcgcaataatgagaacacattttgtgatccagttatccatcgtctttgcaacggttttcatctcaccaggtatattgatgtgctgaggacatgcctggacacattttccacattgcctgcacaatgacgcattagcagaagttcccatgccacccatcagttgcatcccataaaatccccgagtaatcatcttattaccgagcatgtggtattggttatagaagtaaaaacactgaggtatgttgacgccgaatggacagggcatacaatatgaacacccagtacagggaattttcatgagtcgtgaatataccgcttttaccttttctatcgtctccagatcgttcaaattgagataatcgggtacggctttttcacaggtcgcaagattctcggcaagatgtcgttcatcatttagtcctgacagtaccacggtcacgtcgggatgattccatacccaggaaagggcccattcagccgctgtcctgttcaagcctgactcattgtaaatccgggaaacctctattggcaggttctgtgcaagcatcccaccccgaagcggttccatgacaataatggcgatattttttgaggcagcatatctgagcccctcagttcctgcctgattttcctcatccaggatattatattggatctgacagaaagtccagtcatatgcatcaataatctctttgaacgtctttcggtcaccatgaaatgaaaacccgatattgataatcttcccggatttttttgcttcttccaaaaaatccatgacaccaagatccagaagttttttccagattccggcatttaacgagtgaaggagataataatcgatataatcagtctgaaggcgttttaattgaattgacaggattttatccatatcctctcgggtatggacattccagggaggaagtttcgtggctatccgtaccttttcccgatatttatctttgagaattctccccaggactttttcactctcaccaccatgataggggaaagcggtatcaatataattcaccccgttatcgattgcattcctgataagccgggtggttctctcttcatcaatccggcctcgttttgtcgggagtctcattgccccgaatccgagcgctgaaaggctatcaccattttttgaaacagtacggtattgcatggttgacctcatagtatttgactgactggttagtctagactgattagtcagttaaattatataggtcatccggtcatgtatactgatcagctacatccttaaataataccagttctatctggtagtacggggtggactcatggacaatcgcaagagggaaaacgcattttcagggcttgaggcagcaattgtcatgattgcctttgttgttgctgctgcagttttcgggtacagcatgatcagtaccggaatgtttgcaacgcagaaagtccaggaagtcacctatgcaaggataaaacagagtgcatcagtagcgataacagacggccttattcgtggacattataatgaagggcagggaggcctgatatcacttacattttcgatatccgttcctgaaaccggagaagcatagacctgtcaaaaatggtctattactatgtcagaggaaatgaagggggcaatccagtaccactcaattatgtccgaattccgggataattgaatcaggagagaacaccagagtcagacttaatttacaaggtgcaggacttgccgggccccttgccgttggctctttcactcttgaaattaagccgccggttggtgcatcaacattattacaacgaaaacttccttccgggtataatggtgggtatatctcttgatttatccaccccttatcacaacccgagattgaacaatcggatgtataatgtataccccaaaccaatgagatattgtgggataatcaacgcattttcctgcactctatgacatacaaaacccggtcttaacttcggtcaggatcaatggcgattatgcagagatcatctatgaagatgatggaacaggcattgctcctgaagaagaaaccagaatatttgaccagaattatgggaagaatacagggaatggattgtttttaatcagggagatcctgtctatcaccgaaataacaattgaagagactggtgtgtacggaaagggagtcagatttgtaatgataataccacctcgcggatttcaaatcagaggataatccgaccgatggcagaggatctgttcttatcttattgtaaaaatagagatttgagtattaccggattgtaaactcaacatattccagttctttctcattctttggatcccagatattggagagagtagtacttggataggctttcttttttattacatcccatccatttggcatgaccgtccctggacgttctatctccattgatgcatcatagacattcatgtgatattttcccttctggaaggggacctttttcaccttttcattgatttcaacattaaaagtcacttttcctgaagggtccttctttaccggaacaatgaccagagcataatcatcaggaatatcgacagtctgatatgcctgagttccatccggattgaatcgtaccatgtttatcccggtttggtttgctgaatcacctgatgaagccaactccttgaatcggacttttccggcattatcttcttttgcatatgcaaccagattgtcccagaactcttttgggaagatctcaattccgatctttttgactttgtcaattgtcgttgttccgctgatgttaaatttttctccggcggcaagggagccaatgggatccacggagatatttgcctctgcacaagcaaatccggtcataccaatgatgaccatggcaattatgatgaattgtttaagaaacatggatttatcacctgtttcatgtgataacataccgttgtgtttttcggtaaacctgaactctataagaatcagttctgtttccataaggggtttcttatcttatgaaaaatgtcatttgttattaaacctcccacaacttccgtaccagtaacggtaagtaaaactgggatgataaataaaacccgttcatcagtaaagatatcccattcaaactcatcaaatacaagtcaggttgtgataaaaccaaaaccagcccctatactcagaagaaaacgattacaaatctgaaaaagtgcatagactcaatagtcatatatatgcaataaaaatttgtacaattgaggggagaaatcggtatgaaaaagggattatctcccagaacttaccgttgcagatccccgctgcagagcgatctttccggtcctgactaattcgagaactccgtatggtttgaggagatcttcaattgcagcaatttttccactatctcccgtcacttcgacaaccagcgtatcacttccgacatcgatgatctttgctctgaatatccctgcaatctgcattacttcagaacgagcttcaccaggccctgccctgactttaatcaaagccagttctcgttccacatgctctgattcggatacatcaagaactttaataacctctatcagcttgttgagctgctttttcacctgttcaatctggacatcatttcccgtgacaacaatggtgatccggctggtatcaggctgctcacaatgaccaactgccaggctttcgatattaaaaccccgtcgtgagaagagaccggtaacccgtgagagaacacccggactatcctctacaaggacactgaatatatgtgcagtcatgttagttctcctcatgctcggcatggtggccgacaatcatctcactgatatttgcccctgcaggaaccatggggaacacattctcttcccgttcaaccctgacatcaagaacatacggcccgggatgagcaagtgcggttcttatggctgcttccacatcagaagcattcctgaccgtagcagcctctattccgtaagcttttgctattcgttcaaagtgaacttccggtagttcggtgtatgaataccgacgctcatagaagagctgctgccactgcctgaccatgccaaggaactgattattgaggacgattacttttaccgggatgttgtactgtgccaccgtccccagttcctggatgttcatctggaatgaaccgtcaccggcaaggacgaaaaccggctgatccgggcaggcaaaatgaacccccattgaagctggaaacccatagcccatggtcccaaggccacctgagctgatccactgacgtggccgggtaaacttaaaccactgagcggtccacatctggttctgcccaacttcgctgacaataattcctttttcgcctaatatatcagccagagtcttgattacaaactggggatacagtttcccatcagaccggtatctgagtggatgattcttcttccacatcgcaactttttcagaccattcaggatgcgggcatgactcaggaatctttttgagaatatcagaaagaacactctttgcatctccgacgatgggaacatccggctgtttattcttcccgatctcggcggggtcaatatctatatgaataatctttgcctgtggtgcaaaagcctctatctttccggttacgcggtcatcaaacctgactccgatggagaagagcagatctgattcggtgatggcataatttgcatactcagtcccatgcatcccaagcataccaaggttgagcggatgatctgtcggtatacaccccagacccatcaaggtagtagtgaccggcatgcacatcttctcagcaagggcgacgagctctgcagatgcattggatgagatgacaccacccccggcatagatgaccggtcgttttgcctgaagcaggagatctactgcccgctggatcatcttgctgtgaccctggtacttgggtttgtatcccctgagtcgtggctgctcatccgggccgtctacatccggtaccatcgaagtgcatacatcttttggaagatcgatgagaaccggccctttccgtccggtacttgcaatatgaaatgcctcccggatgatgcgtctcaggtcacgtgcgtcagttaccaggtaattatgcttggtaaccggcatagtaatcccggtaatatcagactcctgaaaggcgtcatttcccaggagtgatgtcgggacctggccggtaattgcaaccaccggtattgagtccatgtatgcggtggcaagaccggtgaccaaattacaggcaccgggaccagatgttgcaagacagaccccggtcttcccgctggcccgtgcatacccgtctgcagcatgaatagcggcctgctcatgacgaacgaggatatggcgaatatctgcatcatagagttcgtcataaatcggaagaacaacaccacccggatacccgaagatgatgtcaactccctgttcttttaaaccttcaatcagtatttgtgctccgcttttcatgatattccctcagcagacggttcatcccggtgatgaccgcctccacgctggcctgaataatgtcggttctggctccgcgtgatgttatggtttgtccatcttttctcagttttacggtaacttctaccattgcatctgttccaccggtgaccgcatcgacatgatactcttcaagtctgatatccccggctacagctactgactgctgcaatacccgcaatgctgcatccaccggtccgtcaccggttgctgcaccagtcacttcctttccgttcacctgcatcgtaacagaggctgtcggaattacattcgtccctgaaaccacggtatactgcttgagcgagatgaccggcctgcattcaagaagcatgacagcatcagcaattgccataacatcagtatcggtgactcttctcccttcatctccaagcgccttgatacgctttaccatctcctcaagttgtcgtggatttggtgagtacccaagttcagtcagggccgcctttaccgaagctgaaccagaatgcttacccagaacaatccgccgggttcttccgacaagttctggtgctatcggttcatatgtccttgaatcacggaagagcccatgagcatgaataccactctcatgggtaaacgccattgtaccgacgatcggtttgttggttgcaaacgggactccggtcagccgtgataccagagttgacaaggggtatatcttccgggtttcaattcccgtatcaaccttgtacaaatgctctagtgccatgaccacctcttcaaggggagtattccccgcccgttcaccaagaccatttacggtcacatgacagcagcttgccccggccttgagtgcggcaagtgtgtttgcaagggccagaccaaggtcattatgacaatggatactcagtggtgcaagacagagtggcggaatgatctccgcggtagcctcaggtgtcagcaccccgaccgtatcacaaaaacaaagccggtcagctccatgctcaatgcctgctgcatacagggatctgagaaactccatatccgcccgggatgcatcttcaccggagagttccacaataagaccacgctctttggcatattcaacagcattcatcgccatcgaaaagacctgctcccgtgtcttctgcatcttccgctcaatatgcagatctgaaaccggcactaccaggtgaactgaatctgcccctgcatctgcagcacaatcaatatcctgtggtaaagcccggacataggtgcagcattcagcagacagacctgcctgtgcgataaggcggatggcttcccgttctccctctgatgcaaccgcagaccctgcttcaatgacgtgaactccgatatccgataatgccgtggctatctcaactttatctgcaggagagagagagacgccaggagtctgttcaccgtcacgaagcgttgtatccaggaatcgaaactttttatcgcgcaataaaacaatcactcataggatgtcactcccaaatctatgtcgtcgtcagaatgcatataaattttccatgaaaatggtgtatgttttaaatattggtgcaaaaaagtaagaaatatggtgcaccctcggcccaaaaatctgtcagccgaagattatgatagcagatttacctggctttagcctgaacccggggctcaatcaaagtccatatccagtcagccatctcgcggatgttctttgtctggatatatacctcaccaggaccggtgatatcggtaaccagaaactcgccactaagcagagtctctttccatccgccaaatttcgtaacctggtactggcaggtatcactaaaggcaaccaggtggaagttatcaacaatcagccgctctccaggtgcaagcacatgcttgtcgatggctccaaaggtattgatgaagagcagaccctgacctgaaactttgatcataaacagaccctgaccaaagagccccttggtaaatccctgccattcaacatccagattgacatctttttcagatgccaggtacgccgccttctgaatgatatatcccttccccggagcaacctgcattgtgtcaacgtcaccgagtggtgctgctgaaaatcccgcttttccggaggcattggtagcagtaaaatcattcacaaagaatgactgtcctcctatgagggccatcccaatcgacccaaggagaccttttttcctcatgcgggtatgaacttcgatggttggctgcatccagctcatagaaccggcttctgcggtgactgactcccctggcgccagggtcacttcaagcatcgcatatgatggcttatacttgatctcatactccatagtaatcctgtatgatgaccttgatgtatgatacgataagtactctgatcccatcccccttatacagtggtgcaaatagtgcgcgacaatgcaccacacctcgggtgcagaatatccggggccctagatatactcggatgaaaggaaaaaagatatcacgtccacccaaatgattgtaaagagaacattaccagaggctatcatgttagagaaatattatgacaaggatgccgatatgtctgcaatctcctctaaaacgatcgcagtcatcggatatggatcacaaggaagaggacaggcattgaacctcaaggacagcggattgaaggtaatcatcggactccggccgggtaagagctgggatctggccaaaagtgaaggctttgaagtgatggacgttgctaatgccgcaaagaaagccgatataatccagatcctcattccggatgaacaacagggcgcagtatacaagactcagattgcacagggacttaccaagggtaagactcttatgttctctcacggatttaacatccattttggtcagattgtccccccggcagatgtggacgttatcatggtagcaccaaaaggacccggacatatggttcgccggacctataccgaaggaaagggagttcctgcacttatcgcaattcatcaggatgtctcaggaaatggtaaaaaaaccgcccttgcttatgcaaaaggtatcggagcaacccgtgcggtggtctttgagaccagcttccgtgaggagaccgagacagatctctttggagaacaggctgtcctgtgtggtgggatgacatcgcttatcaaggcaggatttgagactttggtggaagcaggatatgctcctgaaatggcatatcttgaagtgctgcacgagaccaagcttattgttgatctcatctatgaaggcgggtttaccaagatgcggaactccatatcaaacaccgcacagtttggagacctgacccgcggacccagggttatcggacaggaatcataccttgccatgcaggagatccttgaggagatccagaccggcgcttttgcaaaagaatggatgcttgagaatatggtaaaccgcccggtatttaacgctcttacccgtgctgatgaagagcatctgattgaagaggtcggaaaagagatcagggcgaccatgccccagtttaaagacctgaagtaattcgaaaataaggtattggatactatcttatcttttttccgggagacagagatggtaaaaccgctcgatatccgggagtatatctgatgcccgtttccgaatcgatctgacactgtcatcccgctggttcatcccacagtgtgcaagattatttcgaagatcagaaattctggtccatatcagtaccatctctttccagtcatcataccggatcaaatcatccgaataccgggttttctcatagggccggttttgcatggcaagagatccaccagtcagggtccgtgagacttcatgacggatatccgcatctctccagtcagcatcaagattcatccggatcatgagcaacgttatcagaacttccctgccaagcgtgacggcctgaagaaacaatcccttatcgagctgaaacccgatcagtcggatctgttttctgacatactcgcccatgtttcgcgccatttccggctctgcggccaggtctgaaagatcccgtgtcgctgcaaggacagggataagggagggagcaaaacgaagtagttcttcatttattccatcaatgtcatgaatggcaccggatgctgcatacaacgcatcaaccggacgggccagtctgaccgcatcactaaactgccacaaaagacttgcccagcttgtaagtctgacgggaggctcaggatgttcgcctgaccggtgaatattcccctgaagatcttttacgagtgaatacatcggctctgcatcaacatagttcgtaactgcctttactccggcaatccagtccagaatgcccatcatcggtttcaaatcgacaaatcggcaaaatccatcatctcctgtgactggtgcatatatcactcctgctatggtgacatggcagacagactggagatatgaggctgcaaggaatgtcatgaatggaagggaatggcacccggcggtgatgtcaaagagaaccacttctttatcttttacagcaccacagatcgtgctgaatatctcccagagctggggctcatcggtcccgaatggtatccagagcttctgaatcgggatattacgcccctctaaatcagatgctatccctgccgcagagggatcagagagacagatgatgatttcatcaggcccatacaggtgaaatatcgcttcctgaaccagttctgtttcaatgcagacagtatccctgcaatatcgtttttttatgaaccgccccggacccgcgaaggagatacatcgcatctgattcattcatttgtatacaggcctatatgtacttgaagacactacacagccggtccatgaaaattgcatttgtctatgatgtcctgtacccggagactatcggcggggttgaaaaacgtattttcgagattggaacaagacttgcagagcgaggacatgaagttcatctttttcccatgttcgatggatctgatgtgagcataataaatcgggatgggctcatcatccatccggtatgtcggccgatgggattgtacaccggcgggcggcgatcgatcattcaggcactcaggtattcctttcacctgtttcctgtccttttaaaaatgaaagtagacatcatcgattgtcagaattttccctattttcccgtgatagtatcccgcttgatcgggtttttaaaaaaggaaaagtgtatcattacctggcatgaggcatggggggcatactggtaccagtaccttggactatccggaattggaggccgggtgattgaaaagattgcacttctcctttccagttcatccattgcagtatcacatcataccgcagaccggatgagagatgaagggtattatggaattccggagatcatcccgaacggtatacccctgcaggaaatccgggctataaacccagcggataagactaccgacattatcttcattggcaggtttatcccggaaaagcatccagaactggtggtagaagcggtccgggttcttatcagggactaccatgatctcacctgtaccatgatcggagatggtccgatgatgaccagaatagtggagatgatacatgattatggcttatctgaaaacattcacctgcccgggtttgtgagtgattaccaggaagtgatcagactgatgaaagccgcccgtgtgtttgtgctgccaagtgaacgggagggttttgggatcgtatgtgttgaagcgatggcatgcggacttcccattgtcacgacacaatatccgttgaatgccgcactcgatcatgttctcccggggtgcgggtattgtgcacgagcttgtgcagatgacattgcaacgggtatacgaatgttcctcacacaatctccggatgtacccctgttaaatgaatatgcaaaaaatcatgactgggaccggataaccagttcagttgaagagacatattatcgggtggctgatgaaaacctacgaagccggaagatatgatcttataaaaccagggttgaatactatcatggaagaagtaaaattctcactgaaaggacatgaaataaccggatatgtcattcctatcggtgacgtaaatcttgtttttgcccggacatcacagggtcttgtcgggtgtggtgccattgatgtcatcgctcttgaaaaatttaagatacctgcagtaaaagttcgtccgtcttcaggcgactcgatcaggaacatcgatgatctcctgaacggcaaagttgcagttatcaacacttttgctcaaaaatcgggtgttatgcaggatatgagtggtgaagaagcactcaagaccctcatgtaatttttgcaatatcgtacataaggcacttatttatgggagaatgagagaatgaagagtatgttttcccacattcttataggagtggatggctcaaaagagagctttcgggcactgagttatgcgatgactcttgcaaagcagtttaacggaacatgtgatgtcatgtattccattcctccccgggtatatgcagagctggccgagcgtgaggtaaaaattgaagagcctagtggtgatgtgaaatttatcagtatgcttcagcaggaagagaatcatatccgggatcttgttcaggatattgcagcaaaagaaggactgaccattggatttcatacccgcgttggtgatccggttgatgccatgatagaatatgtgtcgacatccggagttgatctcattgttgtcggatcatcaggaaaagggatggcagatcggttaattcttgggagtgtcagcaccggcatcgttcataaaagtcctgttccggtcctggttacaaaaccggaagcctgaaaaacttttttgcccttttcagggcctgttgtcatagatattactgttgatttttgcgataaatactgaccagagtggtgttaagacgattaatgccagccagccgatgatcggaatcatcgcaagaccggatacgatgaggaacaggacggtcatcagtatccagacgataatccacatgatgatgtagcctccccatccgattccatcagagatttgtcgtgtgatagcaccgatactgaatgcatccagaattcttccggatctggaaaaatgaacatatgccatattcatgatgagggtaatcagaagaaataccagaaatgcaaggaggatgccgatactcccgaccataagaccggcaaggtgtgtgatctttccttcggagaaaaggccagccagagcagatatgaccccgattgcaccaaatgctatcgcaacaataaatgccggtatcaggtagagaatggttacaatgttcatcttccagccgtcgatgaataattttccatactcatcaatttcaggggcgatgtcatccggatttgcatacacacgaacaaggtacccacttaccagaggcacgatgtttatggtgattatctggataatggatagaatgacgagaacaatccatcgtttccagtgatcgataaggccggttttaacgtaatcagatgcattcgtaataattgcggaatacgatgccatgatacaaagtacatttttgaaggtaaaagagtatttatagtaaattttctgatccggtgctattatgagggatatatgagcatgagaaaatatcaatggcattccaggtatgccatgaacctgtcaatgaacgtaaattgggttttttgattggattttgggagatatgctgattcagggtgtatcagaaatacaaaaatcacatttcatattgtttctgaaaaagaaaagggaaccttttgagatttttttaccttacccacacataataaatcgcatcagttcatataaccaaatttttgagagacatagaaatattctcattataattaccgaacaatttgaacattcgattcattcaattttttcggtaacaaaacataggattgcttaaaataatattaataattgagactatatgggccaggcatcagagattcggtatttgtatgatctgaatggaaataggacagatgttgttattccaatatgagcatggagtgaggatattgcacagattattatgggaaaaattacaaataaggagaaattcgatcctgcagattatattggaattgtgcattatactggttcatctgaggatcttgataaagaggtcaaacagcttagaaatgaatgggaaaggctatgagatattttatcgattcaaatatcatcatttattttattaccggttctgcatccgatgaggtgcttatgactattaagaaaatactgatatcctcattttttacctcaataattagcaggatagaagttttaggatggaataaacataccgaaaagagttacagaatgactcatgacctccttttagtactgtgattccagttgatgaagcggttgcaaatcacgccattcatattcgacaaaattcgaatatcaaacttcctgatgctgtaattgctgccacagccatgaacctgtcagcgacactggtaacaaggaattacaaagattttacatcagttaaagggatagagataatgaacccctttgaatctctatgaatatttactaaatattttaccactatttatttataaaatactatttcgtatacaaaaaacattagatttcaatcatataagcccataaaaaacaacaatcaaataccatgctagagcgaaattatttaattgttattatcatttcaggtattgaaaagatgagataaaagaattattccggattaaccggaatatcacaggtattcaggatcgtaaaagaaattacacgtacaatgaccagcctgctcaagctcatgcacatgatacacacagggacagatgatagccttatctttctccttatccccggacctgatgcgacagggacaatatcgttctccatgcttttcagaattccgggatagcccttttatcacggcatttgtctgcttttcatcagggttcaggacccatccgtgcgatcgggaatactccagagcccaacttcttatttcttcttcagtttctgccacaggatctcccatgtaagtgtcaactcacacagacttcaatataatggaccataaggtaaaaaactttttatagacacactttaaccagggaatcagatcattctcatatcttcgagaaaagagatttgtcagggtatggttcatcttagtaggatacccagactgttatactccggaatccggaattatccgtttgagaacattccggtacgcggcaatgacatcgcccttgtcaaaccggtacacatccttatcaaatgactctccggtttttttgtcccaaagccgcatggaatccatgctgatctcatcaccaaggtagatagtgccgtctgcctttccaaactcaagcttaaagtcgacaagtctgataccacactcatcaaagaaccgggtaaggaccttgtttacatgtaaggccatctccttaacctttcggagttcatcagcagtcagaatgtgcagaacctcaataagatcatcattgatcattggatcgccgcgctcatcatctttataatcaatagtgaccaccgggcgatccagcaccattccttccttaaccggatatttcttggtcatggaaccggcagcaacattccggacaatgacctcaagcgggatcatctccagtcgacggacgatcatagtatcaggtgcagacatccggatatgatgagttggaattccttcggcctcaagcatcttcatgaagaattccgacgccgttgcattaagtcttcccttgtcagtaaactggtcatgcttgaccccgttaaaggcggtcatatcatttcgaaagacaacaatcagttcatcaggattctcactggcataaactgattttgctttcccctcatacaggggttttgccggtatcacggatgtacctctcatatgtattgtgttctcaaggctgatgatacaatccctgagccgtgggtgataccaccctctccgtatatattcaggataaatacagagccgttctttaagcgtgtaccctttcgttaaggccgcaagttcatcaaaagccggccagggatgctcaggatttacatagtcaatcgtcaccggggagatgccaccaaggtctgttaccccacaagggaggatttgtgcagcgtcggcaagatttggagggatttgaatggcaatatcagaaggaaggatctctttcgccatccggaccgtctcctgcatatcacgaagggttgctccaggaaatgcactcatatcagtacctggctttgggcagaagttctgaatgatgatctcctggatatggccatattttcggtgaagaccggcgattacctctaatgattcccgccggtctgaccgggtttcaccaattccaagtaaaatgccggtagtgaacggtattttaagtctgccggcatcctcaatcatggcgatacgccgtgcaggttctttccccgggcagttccggtgcgctgggatgtcggcggtggtctcaagcataagtcccatactggcattgacatcagcaaggtagctcatctcgtcagcagtcatgatcccggcattggtatgcggaagaagaccgagacggagcgcctcttctgccattgcatgacagtattccaggatcgaaccgaaaccatactgctcaaggaaaggcataaaacctgccacctcttcaggatgctcaccaaaggtaaagagggcctctgtgcatccggcctctgccccgcgcctcagtacccgtatgacctcgtcaggtgaaagaacacaaccttctccaggcgggcgacggaatatacagtacccgcagatatttctgcagacaaaggtgagtggcacaaaaacattccgcgaatatgtaattaccggtgacatgataccacagctttgtgcatgagatccttatggtggttttgaacctgcagggatatgccgatccttatttccattcctgatggtaacgtttgtttcagagatgcggatacctgttgtcattccctataagcccattcagcccaagacccggctctcctgtattctgaccgatgaagaacgggaagattttgctttcatgatgcttcgggatgtggttaatgccgtaaaaaatgcaggctgttctcccctcatccttgcaaccgcaccggtcgaacttgacgatgtgccggtcagaatactggaagaaggtctcaatgaaacaataaatgggttttgcgaaggaaatgatgagcctctggcaattgtcatggcagatcttgctcttgcagaccgttcagcaatccttacccttctcacatcaggaggtgatcttgctattgctccaggtcggggagggggaaccaatgcaatttatgtacgatctgcgaaaatgttccaggcccagtattatggcatgagctatgagaagcatgtcagatatggaactgatgctggtctgatggttaagatcatcgattcattcagactctattgtgatattgatgagcaagatgatctcatcgaggtgttcatccataataccggatattcgcgggaatggcttatcagtcatggatttgagatcgctatgaaaaagagtagaatcggagtgaaaagacctgggtatgagtaaacatcccgtctatttcggagcgggcagcataagtttggtatctttgttataaatcatcgggatattcattccctgacattcgatgatcatcacttcaaccaggataaatgccttagcctcacccctgagacacccggtgagtacctgatctcgtcttcctgcagagatgtggaggtgtatggcaggaccatcatctccggttctgataaaaccggtcccgatcagttcgtgagccagaacaactgattctgagtgaggtattggagggagatgatcaacttcagggccggttaccagctttgcgttctttactgccccaatgaagtggatgatacctgccttgatctcatgttccctgacaaatgcgttcattgtctgtatcggatcttcaccatgctctatatggaggtaaaagatccttccacaggttccggatgtatatttcatcgataattatttttcatgagacgattttagttcactggtttatcagaaaggatcatttttcctgcatgatgacgtcatcatgatactcccgtctggtataggagtacttgtctgatatcccaccctggaggacgatataataccactcatacagggtgttccaaaacccgaactcatgatacctgcggaaatcaaacccgaccttcatatccggagcaaattttacttttcccatcttccgcatccggacagcaatttccaggtcatctccagcgtccattatccggtacattcctgccttaagaagagcatctttcctgaaagcagtattgcatccaagtgtataataatacagttttgaatgagctccgaattttataaggccattaaacaggagtgcatatcgtttattaatatcatttttctcaatcggtgtgacaggcccaaaggagagaactacacgaggatcagacaaagacctgacagcatgctcaacccagtccggtgcaacaatactatctgcatcggtcgtcgcaaccaggttggaacgggcacgaagaaacccatcatttcttgcccctgcaacccgttcagactcctgaacaaagaccatatcagcataatcctcggcaatatcatatgttttatcatgcgaacccccatctacaacgattatttcatattcatcacgcgggatggtctgatgagataatgcttcaaggcttctttttattcttttctcttcattatatgcaggaattacgacggatatcatgatatcatatgcatgtaaggatatgaatgctccagtattatcttatactgctactctcttacatagaaggtttattcagaaaccgtattcatgacacatccggatgttgtccggaaggagaatgatgtgaagatttcatcccgtggattgtttgcaatatcacttatattcagtttatcggtcattttcattgtatttggagcaacgttcaccgaagagactattcaatatattctctcatttaacctaatcttccttattctggccatcggttttcgtatcctggccctggcgctctgggggcttcggatagtcctcatgtcccgatctctcgggtatcatgtagggtttttctactctctgaacatggttcttgcaggattgctggccggaacaataacccccggtcaggctggaggagagccggtcagggtccatgaactctatcggaccggagtaaaggtaggagatgcgactgctgtcgtcatcatggagcgggtactggacggtatcgttctgactggcatgggagttatcatcatgttcatgacacgagagatctggagcacattcagcacaagtcttattatcctcatcatcgccgcctgggtctttctactcagctttcttttcattcccttccttgccatgcggtacccggtccccatgaaatgtcttattctccgtcttgtatcgtggattactgaaaaattatcgcatacacggctttcatcgtcaaagatctgtgcctgtgcagatacagagattgataacttttttacgtgcttttcacggtttgcaggaccggcacgatggggccttcttatcggaggaagtgcaacagcatttttctgggtgactgaatttatggttgcatctgttattctgatgggtctcggattggacccatatattatcctctcctttttctttcagattctcattgccatcatcatgatgatcccgaccactccaggatcatcaggtattaccgaactctccaccagttctctgtatgcattgattgttccggcaggaatgctcggaatttttgtcctgctctggcgatttgtgacgttttacctgaatattatcctgggagttattgcagggatgtgtattgttcaccgggagatatcctgcagaacagaatattcaaaagagattacccctgacaaaccacaaccataggatcaaaagaggtgacgaagaggattaaatacggtttactgctgctgttactggtccggtgcattgtggttttggatatgccaccttttcccaccggtccagaacctctgaaccctctatgaacgcaaggtcatgacgttttgcatatcgtattgcatcttctttagagagagcatatcctgaatcatcatcaagcatttcgcagatggtgatacttgggataataccagacatctctgccatggcaatcgacagttcggtctgaccatgacgctgggacaagagatgttcagccgcgatgagaaccggcatatgacccggagttctgaaatgttccttgaatgatgaaggctctccattcatgactgcctgaactacttcagcaagtgcatttacagttttcgtccggtcccggtcggtaatcccggtgaaggtatccctatggttgacccagagcgagaacgaggaattattggacggatcataggggatatctcccagtttttcaaccatggcacagtttcggaggacttcacgggcaaatggaagacctagtttcttagctgcctggaagggtattgccgtgcagataagtccgccggcatcatttcgcatccggcagatgtcgcggggagttatcatatcagaccgcatggcaaaatcggtctctcgttcacggtcatcaaagtcatacagcaggaccatctcaccctgcctgagtgcagtaaatgcgtcttttgtcataatgtcacctcaattgttacttcatcgccatcttttaaagaaaatcgttttcgaaggccttcaggagagacaacttcgataagttcttcaggataatgggtccgcccgggaatgataatgccacagggaacgtccctgataaaacagggaagacacctgacatctccaaatgtccgtccttctgactcaaatccctgcacgaccttccactctgcacttgaaagacgcttcctctgaagggttgctccaggaagaaggcggatattcaaagtaccgggaaatggggtaaacccaaggattctctggaactgatcagcgtagggttgaaggctcatataatacgccccctctccaagaccggactgaacggttccattcagcatcagagatttttcctgccggccaaacaggcggtagtaatcacagtattcctgacggagagcatcttcgccgccatgtgttatggtcacctgttgtccgtcagttcccaaagtccggctgataaaaccctgctgctcaagcgagcgtaatcttcgggatgccgtctgaggactgaatccaagttcagaaccaaggcttatcgttttgaggaaaaccggagtgttcagaccgcccatgagggcgatccgtttcagacattccagatcctccggagtaaccatgatatcatatgtgagatggatcctattaatgtgtttccatatatggagaggatatcataagtgatatgatccaggtattgattccggagttccaaccagactacatatcacacatcccttcatatatcaccatgaacatgagtactatgaaattctcatctgccatctctgtcattggtgaagtcacagcgaatgtcactaaaaaccagaggtaattgccagttcagtgaacacgactatctcatttgctaccatgcccgcagttaattcaccaccatatacttgcaaccgatgtggctattgctgcagttacatgggcgatgtttttggcatcatggaacagatcggaccgtttgaatatcttatacaataccttatcaccggtgttcggcaggttgtaatcattgatcaggacaaaagagaaattttttcctctacgacaattctcgatcaaagaccacttgcctgcccattcctccggtttgatgacgaacagcttgccatgtgcacagtccatcagacacggcctgatctttgccgcatgtatctgtgtgagagatgcagagggaatgaaaaatcccatgaaccttgggacccagtattagattcggacttttctctcaacccccctttaacatatcacatgatttgacaaacgtaaccccagctgcccagtacattctcatcctgatgatgccacttttgattattactattgtcttgtcgtttatcacccaggcaaattcatcttagaccagaattttgggaatcacttgtagaactgcagcacatcctcatattctttgtccttcatgtggcagcggtcaggatatgttgcatcaatgcagcacgacaaaccggggcatttgaatttatcctggctcaacccgatgtttttcatacattcctgacagacggaggggccaatctttctcagggaaaaaagacgctgaccatcgcccgagccatggtcgcccatccccataagctcatccttgatgaaacgatcagtaatgttgatacacgaacagagaaagttatccagaatggtctatttcatctgcaggaaggaagaacatcgtttattatcgcccatcggctctccaccatccgacatgcagattgtattctggtcatacatcagggagagattattgagcggggaacccatactgaactgatggataagaaagggctttactataacctatacatgaaccagttcagagggaaactgagcggtatcaccggagtatcctaatatttccccgtttttttcatagtaattactggaacttgcattaactccaggtactcatttgagatcatttcaaatccgaaatgttcataaaaaccgatattttcttcattctgcgtagtgagataacagtcaattccaattttctccacatgatcaagaacaggtctgataagtcgccctgcaacaccctgattctgataatcgggatgtacaccaagtacaaaaagatagaggtgaatatagggcatctctgtcatatgctttttatcaatgtgatgagaaaactccaaaaccctgttcatagcttcttttccgatcttccgctgaagtcgtattccaccactgataagacctctgaaggtagtaatctctgatttgtctgatggaagccataaggcgacacctctcaaaggatccggggtagtatatacccatccatatcgcagggtatatgttaattcaaaccggaagagctcggattggatggtatggccttctcctttttgagagaagagataagcaatttttggatcattctcaaaggctgatgtgaggatgtcagcagcaacagtgatttgttctctccgtaggggcattaaaccagggattttaccagatatcatcgcatttcatctcttcagaatatcagtagcattcatgaatgggctatccatagtactgatcagagggactgtcaaaagcactctggatctgaatcaattttttcagagggactgatggattatggtacctccgtttattcctgtgtttctcttccagttgaatcgcctctttggggcagagattgatacatgccagacagaagagacaatgatgctgccaaaccggcttattgtcaattatccggatgttatcagcaggacaaacctgattgcatataccacatccattacaagtgtcatcaacatgaaaccgggtatcaatttctgaaagactcctgatgaaccggggataaagcaggaaatggagtagctgactcagtacaggaaatcctggcatctccttcttttctgcctgaatggagtttgcgatgttggcaagcaagctctctgcatctgaaagaagattttttgagtcttttcatccggagctcccccatacggaatataattatcaaccatccggaccagccatcctgcctgaagtgaagacccattttttttcagcatcttgtcaagttgaagaagggcatatcttccaatacctcccgctgttgcaacggcaaaaatataggggacatgagagagggagactcgtggaataaattctgacagtataaatggtacaccacagtaattaaccggaaatacaaaacctaccttattcgtatcaggaatcactacacccgcctttttcatccgaataggaatcgactcgatgaccgtgtcaccgagtttttgtgcaaggaactctgccgctgcaagagaatttccggttcccgtaaatacatacagagttgttgtcatacgtgggtaatccacggcagagtttaaataaatactggctacttatcacagatatacaaatcataagataccacaatatctatcaggaaggaaaaatctctgcagaaactgcatattcgaaaaagcagggccttcccatgattgcatgggtaattacatccccctctataatgaagcgatcatccggattatcggaacatcattttaaagaagattcaggagacaggatatcttgagaatgaagagataaccgttagaaaaaaagacggaactccttttattgttgaagtctcaagtcattattactacgataatgaggggaatatcgcggtgttgagggaattttcaaagatatttctttgagaaaggagattgatatggtacttatggataagaacatcttgagacgataattcagaatgcaccattcggcatccatagttataaacttctggacgataaacgtttaatctttaccggatccaacacggcagcggataccattcttgggattgataataacagatttattgggaaaccaattgaagaggcatttccggaattggcaaaaacgaatataccggacctgtaccggcaggtagtacgcactggagaaagagtcagaaaaagacaggttaatgatgatgggcagaatatcgtgagtgcaatatttaaggtaacggcatttcagaccggaaaaaatgcgatggcggtttttttccagatagtgccaacagataatcattaaaatttatcaaccatttatatctgaatctctccacccagaaccgaaaaaggcaaaatagccctgccatccgatatgaagtacaaccggtgtgttatcatggctggaattatatctgaactgatttgaaagtcgagagtgatggtgggattatctctatcatcaccctgtgaaagagctttttgaagattatctttttctaaaacatggatacttctccggtttccttattaagcacttcaactcgtgtcaaagttaattcatcttctccaaaccgtgaagtttcaaggacatatgacagggtaaccagatctccattctccgaaatgctgataagtgaagaaactgacagagatatatttcgaatatcatgttcttccggtaaagggctatgacgggtggaagtagtaagaagaatacccgcaacaataatcgcaacgataataaatcccaaaccagtaagatatactacttttttattcataccttcctccggattacgcagttacgacagtacaagccctttcatgaaaccagcacagaaaatgaataattgagagatcattatccatcccttccataatgcaatgtgaataatccgacatactcatctccgtaacaggtcgaatcagagcgaagagagaattccggttcaagaacctgactgaacagatctaaccactcttttcgaagcatatgataatcggttctgatccctctcggttcagataaaattgatacaacctcagtcatgaggaacgaatcgatacagtcagtgacaacctcaaccggggcatcatgagcaaaaacaaaatccatgatcctcccatatgactgatacaccgaaaccgcaagttccggggaatacatctccggtgtatcattattcgcatccagttcaaacagaagaaagtggctaatccatggctttaaccttgagagatgaattcgtttatcctcaaccggcatatgatgatatgcaagagaactcatcgcaatatcgtaatgtctgtcaaacgataatgaacaatcctgaatcctagcattatccgttgaaataatcacatcaggaaaggcactcctcaccttttctgttgccatggagatcatcgccggagatggatcaatgagcaggacctcaccaatttccggcactttcttagattccatgagatgagccaggagacggcaggtaagtgcaccatctccacatcctatatccatgaagcgaatcggatgatcgaattccggaatcgaatgagaaaactgctcgatattctttcggtttttttccggcttgaacaatttcacggaccaggtgagtccagagttctatttcctgttttgaaaggaaggcatatttttaccaatgaaaggaatgtaagattttcagcgtatctctgcactacataggttctctatacccacggccacatacccggttatctcctctttttcgttccgtaatgcccgggtattccaggtgatagtatgcagtcttccattttttgcatgtatctgtgtcttcaaatttgaaaaataactatcatcagaaatgatatgaacaatttcactggttatctctttccgatatgaagcatcgggatacagggatttccatatccacttttttccgaccacctcatcggctgtataaccgcttatctcttcagcggccttattccagatgacaatatttgtttccttgtccagaaccatgatccataccagggcattctgaatgacactctcaaggtattgcttgattgagtgcagctcttcctgggctttcttctgatctgaaatatcctccagtatctcaactgccccgatgatcccaccatcttcatttcttataggagctgcagtaaaatagagccattttccatgcgtaccaagagacgggaagaaatcaaccgcctcataggctccaggtattaattttgatggggagtatttaccggcataccacttttcaatctgatcaggaacattatcaaccagcaggtctgcaagacaaggcctctcttctttataaaaagcccgccattgctgcgtggatccaacgatctctgaagaagagatgccactatgcttggaaagtgccaggttccagaacataagtttatgatctttatcaatcacgaatgccggaaccggagattcgtgaataactgcgttcaatatgagaccctcctgttccagtttccggtaggcttctttctgctctgtgatatcctcaagggtttctactgcaccaatgatctctccatcctcatttctgatgagggcagcagtaaaatagagccattttcctgactctcccatccggggaaaataatcaaccgcctcataggcatctttcaccaggccagaccgggaatatgtccccttataccattgtgctattttatcctcctgaccatccacaagaagatctgcaaggcatggcctttcgttgagataaaatgccatccaatgatttttggttccgataaccctggatgagggaataccactgtacgctgcaagagcctcattccaatgagtcacaatatggtttttatcaattacaaactgaggaataggattgccctgaataaccgcctcaagtttggatttactctcgataagttctctctgtgctctcttttcatcggtgatgtcccgtgcaacaatagtaaagccggatatggtatcatcttcatccagacgaattgacattttggcactatatgaccgattctctcctgacacatgcatgtcatagtatatttgttcggttcgaccgcttacaatcaccgcattcatcgcagatcctaaaagatcagacagatcaggcgggagtatctcacgataatgatgcccgataaactgttcgggaggaataaaatattgcccggtattttcattataggcatcaagaaatacaccctgtgtatccagagtcaggaccagatcatccatcgaagcgagcgtagaacgaagtttttcctcactttggcgaagtgccttctcactctgggagatagcaatgtattgatgacgcaattcctcctctgttgccagtatctcctcatatgatgcccccaaatcctctgtttttctttctaattcattcagaattcgtttatgctcggagatatcacgaatgatcgacaaaagaagataatttccctttacttcgattctgtttagactcacttctactggaataaacgttccgtctgtttttttaagtttccattcaaaaaaccggggattaccatcaagagcttcctgtatcagaatacctgccttatcgatggataatgtattgtcatcctgatattccggagagaaagcaaccgggctcttcccaatgatatccttcatatccgctgacaacagttcttcagtgcggtgattacattcgatgatccggttgccatccatgagaaatatggcatcctgtgctgcctcaaagagagtatgatataatgtctcactgtaaataagatccgcttctgcttttcgttgccgcacaatctgttcaatattatttttaagttctgcaaactgagaatgggggtctcctcccttttggaggtataaatcagctccttctttcaaagcctcaatgacgatctcttcacgaccccttccggtaaaaattatgaaggggatcgttttgttatctcttctgaccgcctttaaaaattcaattccatccattccgggcatctggtaatcagatatgatcgcatcaaaggccccagaagtaagaagacttagaccttccaaagctgaagtcgatgtggtaacctgcatatctcctgaacgttgcagaaacaatctgcatatgtcaagaagcactggctcatcatccacatagagtactgatatcatagatgattccaaattgtgaatgcatacctgcaattcaactgatacacacatataatcatttacagggtttaaaatatctgctatctcaaaagagtgctaaaaaagaatttctaattttatttttatgttgaaatatttactcaaaaaatattaaaatggaaaatatactccttccatccaatcagaattgtatatgatatcctttcagatactcagcactataaatatgattaggaggagatgtattcccattcttcgattcagatatacaatcaccgataagaaaaggagtaataaaatagaatggttaagttactcacattcgataaagggaaagttaccggcactcattcaattgctgatgcgtgtaggagactttcttcgctcctgatgcgaggagatttaggtcttgcaattgctgatatcgtccttacatactcacccaacgatctgaaacagatgaaagtgaatttttctggaaagatcgattcactctctccggattataaaaaagaacttgaagagacgattgctgtattccttgacggaacataccagaacatccgactcatgaaccagcagggttcgtttgcaacgattcaggaaccagtttcagatcaagcgaaagaatactggatgatggttgcagaccgatgctcaaccggagatatacctggaaaccgacttcgttttttaaaatttctcctttcaggtttttgtatgttcgtccaggagataccaggtcatccggttggcatgcccttccccggaggagataaagtcgatttcatagacgggaagtattattgcccggtccgaaccaagtcacatgatgttgatgcagccctttgcccgttttgcccggcagaacagaccccggatatcggatatctcaagccaccaataaagggaagtaaacatcgaaagcaggagtatattaagaatatctacgattatcatcattttaacgggtaaatcggagcagttctcatattcatttctgctaattggaggaggaataattggtaagatactcattctccctttccatagcttctctcatccgactctcaataagcggtgcattcttcctgcgataacccggaacaccgtgtcttgaaaagttagaaaagcaaagtcttatttcttatacaagtccatatacgacagatatcatgagcgaagaagatattaccaacgcagaaatagatgcggctgtcaggagtatgccctggtggctcgttcttgtctggggaataatggctatcataattggtctgatgtttatcactactcccctgatcaccacctattacctggttctattcatgggagtatactggtttgttggaggaatattcacccttgcgagtttgttcagtgataaaacaaacatgggatggaagatttttcttgcaatcatcagtatcctcgctggaatcgcaatcatggcacaacccctgtttggatcaattattgtcgtgacaatgctggtgtttttcatcggattctggggtatactcattggtggaacaaaactctatgaagcgatgcgatcaaaagatgccggagcaggtattcttggagcactcagtattgtctttggtatcatcctactcatcttcccatggggagcagcacttgctcttccactgattgctggagcatttgcattacttgcggggatatgttctgtaggagtggcttttcaggtcaagaaggcacaggcctgaaccctctccttttttttcggaattttttaaaatattaaccagccttttttcttgatttcaactatgcattatttttcggtgagaaaagataaaagagggtttttatggtacccgtgtccaggtccctgcagcaacgaccgagtcattatcagtaacatggccatagatagcatacatgaaatcatcagaaattaattcgcatgaggtaaaaacatccatatcggcaaagtgaactgttttatcatcaagaccgattactccgataattgtctcatttaatcctttgtcagatgagaattcgcaatataacacacggccttcctgctcagtgatctctgcatgagcagtgaggttgctaaactttccttcgtgatgcgtgaaatcaccacttttatcctcttacattaaaactgccccctttgactcgacaatccagtaaccaaccagactggggatgtctgaaggatcttcatcaacagcaggctgataagcaataccacacgaacatcctataataaataggataataacaaaaaccagacttgttctcatacaaattttcacagtttcctattgtttttggatataataatcctttacacctttgatcaatgaaatagtatatactcaaaatctcctgattccaggtagaaaaccgatcctattatacccacaaaaattaatcatgctatgttcacatatgaaatttttcagggttttgatcagtattctctgtctcgttttgatatgcgggacaggatttgcggataacaggaatgatgcatcagagtacaccattgctatccatgaaaaaatgaatgacactccagcctgggataacaatgatgaagattttgattttgcaaccaggggttttattgcgacggatgatccgctgactatcccttcggtatatcccgggtatatttcatgggacatggaggcatataaatatctgaataatgatacccgtccggatacgattaacccgcttttgtatagacagagccagttgaataacatcaacggtctgtttgaagtcaccgatgggatataccaggtaaggggatatgatgtcaccagtatgagccttatcaaaggagataccggttggatagtcattgacccgatgacttccgtggaaactgcacaagctgcaatggaactcgtgaatagatcacttggagattttcccgttaaagccgtcatctattctcacccccatgctgatcactaccagggcgtaaagggagtcattaccgaggaggaagtaaagacgggtgatgtccagatcatcgcacccgagcattttatggagcatgctctcagtgaaaatgtatatgcaggcaatgccatgcaacgaagagcgacctaccagtacggtattcagcttccaaaggatgcaaaagggaatgtcgatataggtcttgggaaaagtccatctgttggagttgcttcactcatcgctcctaccattgatatcacccataccggacagaaggtctccattgatggaatagacatggaattccatctgacaacaaataccgaagcaccggtagaacttgacatatggttcccccagaaaaaagccctcctgatggcagaagactgcacggcaacgctccataatgttctgacactccgtggagcacaggtcagggatccgctcgcctgggcaaatgctcttgatgaagccaggcagttatacggagatcaagctgaggtggtcttctgttcccatcactggcccagattcgggaatgataaagttatagaactcctcgaaaaccagagggatttatacaaatacatcaacgaccaaaccctgaatctcatcaacaaaggatataccatggatgagatcgcgagtatgattgaacctcccgaatctctcagggaattctggtacacttacggattttatggccagatctacatgggagtcaaagcgacctaccagaaatatctgggcttttatgatggcaatccgattaacttaaaacgccttccaccggaggaatttgcctcatacatgaccgaatacatgggaggggctgagtccactatgatccggctgcaggagcattatgatgctggggagtatgaactggttgcctcaattgcacattacctcgtctttgccgatccaaccaatatggctgcacgggagatagaagctgctgcacttgaacaactcggatatcagacagagtcaggaactgcacgaaatgcatacctgtcagcagcccaggatctcagacgggaagagccgataaaagagatgagcgggatttccgaagatattatgaaggccatgaccatgagccagttacttgattatatctctgtcagggttaacaaggaaaaagtcaacggtgagaattaccagatgaatttaatattatcagactccggagacaaggctttgatacaagtaaaaaatgatgtgcttgtctatcgggttgatgtacaatcatccgaagcagatgtaacggtgaccatgcctcgaaagacccttgaacaacttgccctcaatccgacacttgcactggaagatgtcaccgtaaccggagattcaggtttgtttgaccggtttgtcagtatgcttgatgtatttgatccagggttcaatattgtccttccctaacttttccttttttccaggataataacaacctttatcccaactcactacagaatcacaattattctctctcgaaataatgtgattcatgattcggtgtgtgaaattaaaacgtaacagaggtaccatggatgaaaaccgtctttgttcggcaggagcgatgtgtcgggtgcaggcattgtgaggttgcctgtgcgattgcacattcgcaaagtaagagtctgattccggcaatcttggaagaaatgaagtcttacccacgcatctttgtagaggctgttgacaattatctgaaatttccgaaccggtgcagacattgcgaccctgccccctgtatgcaggtctgtccgaccggatcactcagccgggatgaaagtaccggttctgttcttgttgattacctgaaatgtatcaggtgtggtgtctgtgccatggcctgcccttttggaattattgagttccggaaggttatcaagccagcaccggatcgggaagtcaatgcaaaatgtgacaattgtatcgaaaggcttggagaaggaaaaattccggcatgtgcagaggcatgtaagacaggtgctctggaatttggtgagatcaatgatcttatccgggtagcgaggagtgattttacaacccaaatgatcacatcacggggagctgaaatcgaagtccccgtcattccagagaacatcagagcatttcaggcagtaatggaaagacttgcatcattatcataagaggagggtggacatatgacagaacaggatataagaatagaagcggaaaggagagcatcagaccggaccgaccaggagataatcaggaaaacattggacgagggtgttcagaccgtctgggatagatttgcccttcaacagcctcagtgcgggtttgggcaacttggagtctgctgtaataattgtgccatgggcccctgcagaatagatccattcggtggaaagacttcccttggggtatgtggtgcgaatgtggacaccattgttgcacggaatcttcttgatgacttaagtgtgggagctgctgcccattcagatcatggaagggaagttgttcaggttctgcttgaaactgctgaaggacatggacaaggctaccagatcaaggatgttgaaaaattacaccggctcgcaaccgaatacggaattcagacagatgggcggagtccaaacgatatagcaaaagatcttgctcttggtatccttgaagaatttggtactattaaaaacaggatccagttggcggaactggccccggataagacgaaagatatctggagaaaaaccgggatcatgcccagaagtattgatcgtgaaatcgtggaggcaatgcatcgcattcacatgggagttgatgcggattatgtgaatctgctcctacatgcgatgagaacgtcgctctctgacggatggggaggttccatggcagcaacggaatgttcagacatcttgtttggcactccaactccgctcacatcaatcacaaaccttgctaccctgagcagggataaggtcaatattgtccttcatggccataatcccctgctctctcagatgatagtcaatgtcgcagaagaacctgacctgaaaaaaatggctgaggaaaagggagcaaaagggatcaatcttgttggcatgtgctgtaccggcaatgaactcctcatgagaagcggcattccgcttgccggttcattctttgatcaggaacttgccattgcaaccggggcagtcgaggcaatggttgttgattatcaatgtatatatcactccattccgctgacagccagttgttaccataccaaagtaattacaaccagcaccaagggaaagatctctggaactatatacaaagaattcagaccagaaaatgcccgagataccgctcatgagataataaaactggcaatagagaacttcccgaacagaaatcctgaccgggtcagaatccctgaacggcctatgaaagtaatggcaggattctctgaagagacgatcagaaaagctcttggaggaacctacaaaccactcatcgatgccatcgttgccggtacaatcaaaggatgtgtgggtattgtcggatgtaataatccacggattaaacaggactatgggcatataacccttgcaaaggaacttatcaaacgcaatatcctggttgtcgagaccggatgctcagccattgcctgcggaaaagcaggcctattagttcccgaagcagcagatctcgctggagaaggacttgcatcagtgtgcaggctacttggtattcctccagtcctgcatatgggatcctgtgttgactgttctagaattctggtattagcggccaatattgcgaaagagctcggagttggaatcggggatctcccaatcggtggagcagctccggaatggtactctcagaaagccatctcaatcgggacctactttgtttcatccggtgtctatacagttcttggtataccgccgaagatcttcggcagtagcaatgttctgaatctgctcgcagacggagtaaaggggattacaaattctgcattcgcggttgaaccagatcccctgaagaccgctgatctccttgaagcagagatcaaccggaagagaaaggcactaaacatttaaccttccttttggagagcataatggatgaaaagaggcttgacgaaattattgaaaaatatccctatcctgctggcagaacgttaggagttttacgggaaattcagatacaggaaagacacatccccatggataccctgaaactggtatctgaaaaactggacctccctttatccgagctctttgctcttgtcaccttttactcatttttcagtctgaaaccggttggagagcacctaatcaccgtctgtatgggaaccccctgccatgtgaaaggagcagaaaaaatattagagacactggaagaacatcttgggttatcaggagaggtacaggacggcaagtatcttcagacaacacctgataacaagttcacggttgagattgcccggtgttttggtgcatgcagcatggctccggtgctccatgttgacggtgaactgcatggatatgtaacccctgaaagaatcccggagatattagagatgtacgggtggaagcgatgaggattcagacatccgaagatctagactccattcggaaaaaagggctgcaaaagatccagccggggaggcttaggatcggagtagggacatcatcatgcgggatagcagtcggaggcatggccctgtataacctgctggatgagataattcagacgaaaaaccttgatatctctctcgttaagaccggatgtatcgggttttgcaaagaggagccgattgtatcagtaagcatccccggaaaagcccttgttttacttcggaaggtgaaaccagatgatgtagagagaattatctctctcgctcttcatggtgatgttccatctgatcgagtgctctgtacaatttccgactgggaccatatcaccggaaaccttgtctatgggaatgagttcgatacttttccagaatatggagagatacccttcttcgctcatcagaaaaaagtgatccttcgggacagcggccttattaatcctgaggacattgacgagtatatcggtattggcggatattttgcagcatataaggcactcaccagtatgaaacctgatgctatcatcgatgaggtaaagcgatcgggccttcgggggcggggaggagcaggattccctgcgggtctgaaatgggagatcacaaaaaaagcaccaggagaagagaaatttatcgtctgcaatgccgatgaaggggaccctggggcctacatgaaccgaaacgagatggaaagtgatccccacatgcttcttgaggggatgctcatcggggcatatgccatgggagtttctgagggactgatttacatccgggctgagtaccctctcgccattgaacgtctcatgctggcacttgaccaggcacgaacctatgggttacttgggaaaaatatcttcaatacaggatttgattttgatatccggatagcgaccggtgcaggggcctttgtctgtggagaatcaaccgctcttgcagcatccatcgaagggaaaaccggccgaccacgcctccgccctccacgacttaccgagaaaggagtctttggaaagccgactgatctgaataatgttgagacatggtgtaatgtcccggttatcatagccaaaggagcgttatggtattcatccatcggtgcaaaaggaaacaccggaaccaaggtcttttcactcgtcggaaaggttgataatatcggtatggtagaggtccctctgggaacatccctgcattcgatcatctatgatatcggaaacgggggagcattgggaaaagaggtgaaggcagtccagaccgggggtccatcaggagggtgcatcccggtcagactctttgatacaccggttgattttgaaagcctgaatcaggttgggactatgatgggatcaggcggtcttgtggtgatggatgaggataccaacatggttgacattgcccggtactttatcaatttcgcttcaggtgagtcatgcggaaaatgtgtcccctgccgggaaggtctcaaacacatgcttcttatcctgaatcgtattgtcgccggtaaaggcacccgccaggatatcgggctgctcagagaactggctgaaacggttcagaagacatcactctgtggccttggacagactgcaccaaatccggttctgaccacgatgcagtattttaaagaggagtatgatgacctcatctcgccggaggcctgatatgtcactcttcggatccgtgaaccggatggttaccatcaccattaataaaaatcagtatttggctgaagagggagagatattccttctcaccgctttgaggctgaatattgacatccctcacctctgctatgaaaaagccctggaaccatatggtgcctgtcgtctttgtatggttgatgtggtcacctgtggaaagacaacaatgactcccgcatgcaccatcaaagttcacaatggccttgaaatcctgaccgacactccggagatcataaaacaccgacgcctgctctttgaactctaccttgcagaagcaccaaaatcagaggtaatcagggagatggcagcgaaatacggagtcacaaagacgcggtttctcaagaagattgttcatgatgacccgctattcggaaaatgcatattatgtggattatgtgtccgggtgtgtaatgaaatcatgggcacaagtgccattaatttcataaaccgggggccatacacggttatcaatacgccgttttttgaacacaatccggactgtgcagggtgtgctgcctgtgctcaggtatgtccgacgaaagcgatagtgtttgaagatagtgatgcagaacggatcatgcaatcatggtccggaacagccgtccctcttgcaacatgttcatcatgcaagaagtcatatgcaccggagaaactcatggacaaggtgctggacaaactcgaccctgcaattatcgaagagctacgaaccctgtgccctgaatgcaggcgcaaatacatcaccagaatggagatcgggagaatcccaaggtcataatatcatggaacgaaaatcattcgaggagtaaaaaagtataatgagcactcaaggatttcggatagttattaccggaaaagggggcgttggaaagaccacgataacctcactcctctctcatcttttcgcaggaagaggatattctgtattagcggttgatgaagatccccagatgaacctcccctatgctatcggggtttctcccgaagatgctgaatcgattgttccgctctcaaaaaacctggattatatagaggagaagaccggggccagacctgattccggatatggtctcatgttctccctcaacccggatgtttcagatgtagttgagcggtttggaatgaaaggcccgaacggtgtcaacatcctggtcatgggaaccgtagtaaaagctgctaccgggtgcctttgtccggagaacaccctgcttgacgcagttatgagacatatcaatcttcgggagggggagataattctcatggatacccaggcaggggttgagcattttggccgggccattgcaaaaggctttaatcaggcaattctggttgcagatccaacatttaatgcggtccaggttgtaaaacatgcagcagaacttgccagagagctggagataagggatatccatcttgtcataaaccgggttagatccccaggagatatcacaaaagtaaccaggatgcttgccggccatgaagaactgttctctggaaaatattacattccgtacgatgagatgatgtcattatttgatccggatgtacggccaatactcgatgaaccgtcagagtttgtggatggagtcagggaattgatgatgtcacttgagatgcatgggctattgagagcgtgaagaacgaccgatgagtgagttcataattttatcttttctccggataagatgccaaatttaatacctaataatacactatatttcatatcacatgtctgcactctcaccttctgaagatattcgatcggttactgatctgaaacgtcatacccgggagatcctggatcatattcatacaactggtcggccagttttccttaccgtcaatggccgggcagattctgtattgctagatgtaaaagagtatgaaaaattaattcatgccgggaatattgccagattacttgcatctgcagaacaggatgtagaacaaggaaaaaccagatcgtttcatacctttatccaagagttcaagcgtgataacgccatttgagatagaaattacagaatcagcagaggaggatctagagagtatctctttgaatctccggaagggtttcggccccctgatgacctgattcgtgagttcctgaacttccggattcttgatttcttcaataaagagttccatatctgcatgcccgtcccgtgaacctatccggattgggaacagaacatatcttccggtttcatcgtcatcaatctcatcaaaaacttcctgaatctcttcagaagacatcatatactcagataatcggataatttcctcctcctgcagatcaatgatatatctggtgtcaaaggtgcaattatccagagcttctgctatctcatcgattgaaagatgaacgactcgttgattaacatcattatctttgaccatcgaattccccattatccccaaataagatatcagcaaaatatccggaattcagactgtgcttataactttagatgtgttatttgataaacgtcccattctggtattcggtaaatgcctgatccacctcttcctttgtgttcatgacaatcggtcctccccaggcaattggttctcctattggctttccagagatccacaaaaaccgacagccgtcttccccggatgtaagatcaaggacagttcccggagccaggagtgcaagattccggtttttcaaaaagaccggatctccaacccctaccgtgcatctcccttcaaacacgtacatgattccggtaaaaccaggccgggcctgatgataaaacttcgaattcgctgggactgacacgtcaagatattccggatccacgatgatctcacgaaccggaccagttaatcgtccatatgtacctgcgatcacccggactttcgaaccattctcaagagtatccaccgggatcatatcgggagatatctcctggtatcggggcacatgatatttttgcgaccggggaaggttgacccagagctgaaatcctcccatctttccatcaactggctttggcatctcctggtgaataatccctgaaccagccgtcatccactgaaccgctcctgctccaactattccggaatttcctatactatcgccgtgctcaacctttccttcgagcatgtaggtaaccgtttcaatgccccggtgggggtgccagggaaagcctttcaggtaatcagccggagaatcccccctgaaatcatcaagcatcagaaatggatcaaaacggggtatctcatggtatccaaaggctcgatgcagcctgaccccggctccttcgatagtctcacgtgcaataagaatctccttcaccggctgatttaaccccataaatcataatcaacgtgagacttaataaataccaatgaaacgtaatgatttttatattttgttaagttttcaaaagagtattgagatgtcatgatgtgttacctgtaaaggctaccggtttttacgcccatacggacagacatacaaacataatccacaaacgggttcttcctggtgttctttcatattctggaaatactggtcacaaagagcagcagcatacctgacctctcgtgattctccttccctgaaaggctcaccggtaaatgcctgaaccggacagatatcaacacaggcctgacatttcccacattgctcatccatcggctttgaaactgccggaaaaggggcatcggtcagaacactcccccacctgactcgtggtccgtgttcaggggtgataagcatacaactctttccaatccaaccaaaacctgcctgccgtgctgcaagtttatgtgaaaatattgagcatattctctcattatcaaaccgtaatgatgcagggacagggaaagcagaaaatccgttcttctggataatatctgcaaccctggaagtaagaatatcaagacgggtatttatgacctgatatgcatgatgggaataaatgctctttgctccctgtatatcagaggtaaccaaattaacaacagaatcctggagcactattccaaatactatcgcttttgaatatgagcggacaaaatcaccaccctgcctatacacttcatcatggacctgagtaagatcggcaactcctaaatattctgttccatgattcctgcaaagagactggatctcttcaaaacaattattcatattatctgcctgtagcaatttttctaccgtgggtggtatttcagtataaaaccagcggtgatcacctggtcagaatgtatattagatttaaggatttttttgtgtccgcagtgaaaaaaaggtaatttctcttgtaaggaactctgataaaatttaagtcattgaacaacgagaggtctctcatgggagcaaaacgaagctttacgatttatctggtcctcttcagtcttctcgtatgttcaggagtttctgctataggaatcagcacattactggaaggaaacgagaaattcgtaaacgggacatttaccgaagaaaaggaacaatttgaacaattactttcaggacaaagtccgcacacactcattatcagttgcagtgattcacgcagtgcaccggaaatgattttttcaagcggtcctggagaactctttgttcaccggaacataggtaatatcgtagcgccggatgactggagccttgctacagtgcttgagtacggaataaaacatctgggcatagatacgattgtcgttatgggtcatgagaaatgcggagcaatgaaggctctcgggaccggtggaggagacggtgattcatttgttcccggatggcttgcaaattccgctcctgctctttcaagtcttttggcaagaagcgaaaagccagattcaggtgaagatttagattcatggctgcgtgaactggaaaaagaaaatatccgactgcagcttgaacatctgaaaactaatccggacgtaagtctgggacttcgtaacggaaacctgcaaataatcggactatattggaatatgacttcaggaaaagttgaacagattggataatttgagtgtaaaggtatagatatcctgcaaatatcacttgaattatttccaaaaaaagattcggatcatggcttgtaccttaatcctgccagttccccttctccggtcatgtatacccaatatccatgataaggaagcagcatccggttatctgaatattcaccggtcccgccgttcataattatagtaccatactgctgtctgaactcatcaaacggaacacaatatctccagagatcctgaacagatagcaggctgtcccggccgaatatgaaatagttcaggaaaatccgatctaattccatcccttcccaagagaaacaactggtagaacctgaacaggatatggatcaaactgaactggaacatggttgcagccatagaataaatccaagattcttcaaaagggccaaaaacatatgaaccctcagtaatttttagtcgggtggagaaaatcgcgaacaatggcaggaattcctgcatcatacaccgggcaaataattcctacacggccagagggggctgtaattgccttatcagttttcatctgtgaaacaacagagatgagttctgcatcttcaattttttcagagatttttctggcgacagagagagaattcccatttccggtaaaataatagagggtagtcttcatagattattccatgcggatttgatatcggcaacgatggtatcaatagcagcattgtcagtggaggtattcctgtcgaggacagcagtattcgatatcacaagacccttctctttcatccgggcaataaaggggactaatgcctcattgccactttgtgcacttttacaggtcaggattccataactctttttcccctggcatcctgtcaggctttcaatagcaccattgataaccggggttggttttcccgcccagaccggtgacgcgatgatgaccatatcatagccggtaacatcaattttttctggtctgactttatcagcaaggcccttcatagcccgaaaacatccttttggaaccaccatcaggcttgaatattctttttccggagtcacctcaatgggatctccagatagctcttcaccaatcttttcagcaactctgcgggtaacaccagagtgtgagtgataaattattatcgatttcatatttccaccatttccattgttcatactgaacagaatgttaccactgtgaaacaggcatggtagcataatcccagcgttttcctttctttcccgtgatccaaagttagcatcaggttagacacgaagatcactaaagcatataattaattgcttatattcttatattaggtttttgttcttgtaatccaaacaaaaaagagagatcagttatattcttttcatataacctattttatgagtaataaatgtctgaatttgtatccctgcttactagtgaaatcggtgaaatcgcagtaatccccatcagtgccctgaataataccggcctagaacatctgaacccatttctggcaccagggaacacggtcatatttcttggctcttccggagttggaaaatcaacgcttatcaataccctcaacggaacatctgttcagaaaacggaggatatcagagaagacgatggaaaggaaaggcataccacgatggtcaggcatctggtttctctcccttcaggaagctgtctgattgatacgcctgggatgcgggagatccgaatctggactgctgaagagtctgttcaggatgcatttgaagacattgcaaagttttcacagagatgcaggttttcagactgtgcccatgaacaggaaccaggatgtgcagtcagaaaagccgttgaagagggagagagatccgctggtcgtctggagcgatacaaaaaattgctgaaagaagcagcatttgagagaggaaatgcagagatagggctaaaacggtttgaaaagatcagatacaaaggaatcagtcaactcgcgaatgaatatcgggagaagaaaaaatgggatgcataccggtaatacctgacatagccgaactctccggtccaggatagaactgatcaactaaaaaaacaaattcattcaattcttctgctacctaaaatgataggatgacgatcgattggttcaatacattcaggccttcataaggagaacatagtcagacatatggacatacatacataattcttgtaatccggatgctattgatagtataatggcaaccggccatatgggtttgtcttaaaacaactcttcttttctggtgatcagagtacacactcatatagatatggaatgccaggctggatacttcccgcggattggcgaaaacattatcattttatcggatgagaatgatattcagaggaggttattgagatgaaaacaatttttcttgttgcccttgcaacgattattctcctgtgcagctcatctatggttactgcagaagaaaaacccggtatagatattctcactcaaaactcatggaatggatcctgggcatctgatgaatactcacttcttattcttcagaatggttcattcatcgctggcagttatacgccggataacattactgcccgtgatcctggtctgctcaaaggaaccttatcagaagacggatgtaccttttcaggaatctggtctgaagcaggcactgtttctttgattcttgccgatgatggagagtcattttccggcacaggaacggtgaaccaggaggggcttatggaagagcccttcacctatacgatacatggaaccagagaaggaacgagacaagatgtgaataacacctggacaggaacatggaaaaccgggagtaaaacatataatcttacgcagaatggaaccgcactctccggctcatatataccgtttgaccttgattctgacgaacccggactgattgacggagtcatatctgaagatggaaaaataatgaacgggacatggattgaaacgggtaaattttcgtttattatgagtgatgacggtctgacatttaatggaacatatacaacagaactcaccgaacaggctgttacagatagctggaatggaataaaaatttaatttttcctaacccatcttactatcttttctgtatttacctttgggaacatcgatctcaaaccggcatcctgtaccatactgtccattttcgataattgtaatatcagacattgcaaggatctctcgtgtcagaaacagaccatatccggtattcttaccaaaacctctttcaaagatatactttttctgatcatccaaaatcccggttccatcatcctctaccgtgataagaaaaccggtactggtctcggttccacgaacttcaatatatgtcagatctcccccatgacggattgcattttcaataagattatagcagaccttctcaaaaaggggatcacataaaattgaaaccccggctacattcacacgaacctgcacgtctcccgtatcaatctggtgagcaacccgtctgaacacctctccgatatcctgccactcaggtaatttcagtccgagttcctggtatgtctttgaaaaggcaacaaattgttcaatttcagtcaatgagcgcctaatacgatcaatatagtccttctgttcctggtgtaactcattatcatccaggaaggataggaatgcttttgagatcataatcttattcaggatatcgtgccgggtaattccggataaaaggtttaactttttatttgcaaccagtagtgcttcttctgcctgcttatgagaggtgatatctcttaccgactctattgcaccgacaacattcccattcttatcatacaaaggggcagcgataacagaaatatatgccatctttcccttaatttcaacccaaagacttgttgataacagatcttcagacctgttgattgccgggtataaaccatcataagataactcaggatgtaatgcatagtctatgagcaggggccttttctctgaatatattgcatatgagtattggaaatcccctttaccaatcatggaccccgagtcatacccagtaaacttctccattgcacggttccagaagagaatgaccccattcttatcgatgacaaaggtaggatctgggaggagttcaaggatcatctctacccgtgaataggcatcacgaagagcttccttttctgcaaaagagatgattgcctgacgttcaatggtgatatcacggatgtggaccagacttaagatgtcaccatcttcggtgaccttggttactcggatattcagatattgctcagcattatctttggttcgtgatattgttcggctttcatatccatccgaaccggcgttcattgaagattcaatcatctgggcaatagtcttgccaatttcatcgaataaaccagtaatttctcttccagaaactatgttaccggacagagaaaacatctcttcagctgcatgattcatctcaagaagtgtatatcctttacagaggatgatcgcatctacagaggcctgaaagagactcatgtatcgctcttcactggctttcaacgatgaaaacatggtctttaactgatcagccataaatttgaaggaatgtgaaagttcaccaagttcgtcttttcggttaatatcagtccaagaggagaaatcaccatcagcaagggcttttgcggacttgttcatcgcaagaacaggacgggtaatgtaccgtgcaaggagaatacagaggataattgttccaagaagggaacctaataaaatcagcagggtagtcttattgtgagcttcaatactccccatgaaatcagattcaggaatgacaaccacaataagccagtcaagcccatatgagtcttggtatggagataactcaacacgcaacggacccgattcaaaatcacaaataaattgttttctggtcgaaatattggtactattttccatatgatgactgataaaatacgtcactttctgaatgaccggatcagtacattcagcagcatagagacgaaccagctcgccattaacctgatgataaggttctttgatggttgaagctgcaattatctgaccatttttatctataatgaacgcctgcccgttttcagagatcttgatctgctgcaggaagtctccaatcccactcaatgtcagggatgtgtccatgactcctatgagagtttcctgatcagaatatgcaggagtaacagcatcgatactgaccactccttcaagccacatataaatcggtgtccatgccggaccccctgccctgactgctgcctgataccacggtctggtccggggatcataatcaggtattgtcagtgtcttttcccctagacttccatcaggtaacaggcggtactctataaaggaatgatttgtcagtgagtttgaaacgccgtaaaaccgctcggttccgtttaccaatccaggggcacctacctttgaaatgatggtataattgccatcctgctgattagcatagcatactgcttcaatcgtatcaaatcgaaatgataactctctgaaatacgagatcaggtcggaatttttatggacatgtatatgcccgagcctgatactgtcaagacaaagttggtttaccagatgaggggttttgagatattcattcaattgatcggttatccgatcagagacctcaccctgaacctgtccggccagttcattaacagcgaactgactggcctgaaatgaaaaaaatccggtgatacagatagcaaggaaaactatgagtgcaaaactaatggtgaggacggtttgtaatttaaatcttccaataaaatgactgcttttttgaaacaccgtttcttcggactcattaactgaagaatcagaagaaccttcttttggaatctcgtgagagttcatgtatcaggtaggtaaagatctatcattcaaagtataataggataaatatatccatcttatcctggctatggagtaaaataagattgaactgagagatttgcccaatttatcacagaagtaaaattaaaaaaaatgaccggatttatctaaatatcatttccctcaatatttttaagaggcattgaccatgtcggtatgaatcaccaaaacttttaatggtattccaaccgaatccagaatcaggtgaagtactgctatgacaacacaactcatagaatattttaacaagtcaccacggatcggagtactaagtacggcagataaatcaggccatgttgattctggtatttttggatcaccccggatgactgatgagaaaacggtgatcatgggactttcaaataaccggacacttgcgaatctgcagcaaaatccccatgcagtctacctgatcattgaaccgggaacaacaattactgactggaaagggattcgagtttacctggttgcattacagattgcaacctccggaggggatttggatgcgtttaaaagtcaaatcgctgaggtgatagggaaagaatctgcagatatgatggtagcactggtaacttttgaggtcactggagtccggccgatagtagacatgggtcagggatgggaacaatcaatatagtttctcttacggacttccttcaaaaccggctattcaatcccaatttagagagatcatttttcataaaacccttcagggaccgatcctgtaccagttcatgcatgctcttgcaaatggaacattcatggtcttttacctctccggagcgattacactcctctgcacagggatatttttccggtttaatagggcacaacagaaatgtcaaaaaggatcaaatcatgaagattgattactcatcggaaaaaaaggagactgtttttagatctcaccgttcaggtatttcgaaataccagggacccatccttttcatccacaatgatctctttctctttcgtaacctctccggcaagtatcatcttcgagagttcattgagcaggtttctctggataacccgtttgatgggacgtgctccgaacaggggatcaaacccgaggtttgctatatgaccgattgctttctctgtgacggtgaacctgacatcattcttctcaagcatcttcctgacgatatcaagctgcagtttgacgaccgtacgaatctcatccatggtcagtggcctgaacatgatgacttcatcaatccgattcagaaactccggacgaatcgtcttcttgagaagatcaaacaccaggtctttggtctgatcatagatctcctccctgtttttgtcagtgacatgttccaggttttcctggatgatatgtgacccgatgtttgaggtcataatgatgatggtattcttaaagtctaccgtccgccccttattgtcagtcagtcggccgtcgtccagaacctgaagcaggatattaaagacatccggatgggccttctctatctcgtcaagtaataccacagagtagggttttctccggaccgcttcagtcagctgacccgattcctcatatccgacatatccaggcggagcaccaaccagcctggaaaccgtgtgccgttcctggtactcggacatatcaatcctgaccatgctgttctcattattgaagagaaattctgcaagggctttagctagttctgtcttcccgacaccggttgttccgaggaagatgaatgatccgattggccgctttgaatctgacagacctgcacggctccggcgtatggcatcagataccgcccggatagcttcatcctgaccgacaacacgcttatgaagttctgcctccagggtgaggagtttttgtttctcactctgcagcatcctgctaaccggaatgccggtccacctggaaaccacttcggctatctcttctgcatccacctcttcattgaccatggccgaatctttctgcaggtcggtcagttgttgcttcagaccctcgatgatcttttctttctcagggatccggccatatctgatctcagcaacctttccgaggtctccggcccggttggcactttctgcctcaaatttgagatcttctatctgatttttcagcaactgtatctgttcgacaatatccttctctgactgccattttgccttcagccggttccgctcctcggtaagatttccaatctcctcattgagagcatcaagtttaacctgatccttttcccgtttaatggcttcccgctctatctccagttgcctgatcttccgctcaattatctcaagttcttcaggaacggagtttatctcaagccggagttttgacgctgcttcatcgatcaggtcaatcgccttgtcagggaggaaccggtcggagatataccgctgcgagagttcaacggctgcaattatggcttcatccttgatccggacatgatgatgtgtctcgtatttttccttgataccacggaggatggatatcgcatccagggtatcaggctcgtttaccatcaccggctggaaccgtcgttccaaggccttatctttctcaaagtacttctggtattcctttaaggtcgttgcaccaatgacatgcagttctcccctggaaagagcgggctttaagatattggcggcatccattgccccttcaccagccccggcaccgacaagggtatgaatctcatcaatgaagaggatgatttcgccgtctgatgagacaacctcttttaccacactcttgagtcgttcctcaaattctcccttgtatttcgctcctgcaatcagggcacccatgtcaagggagaagatctgcttcgtcttcaggttatcaggaacatcaccgtcaataatccggtgtgcaagaccttctgcaattgcagtctttccaacaccaggctcaccgatcagtatcggattattctttgttctccgtgataggatctgtaagacccttctgatctcatcatcccggccaatgaccggatcaagttttccggagaatgcaagttcattcagattccgtgcaaactgatttaaggcattataggtctcttctgcagtctggctgctaactgtggaccctttcctcaaaattcggatagcctctttcagatccttttcagtcacgccaaattctttgagcagtcgcgaagttggctcattcaccgagagaataccgagaaggagatgttcaatcgagacgaaatcatccttcaattcctgggcatatccactcgctttctggagggcttttgatgaatcgtgtgaaaggtactgttcccctccagtaatttttggtaatgcctcaatatttcgatccagaacctggtttaaccggtcaagattgacattgagttttttgaggaggtaggggatgacattctcatctacaataagcatccctttgagaatatgagcaggttctatcgcctggttctgtttaccagcagcgatatccatcgctttctgaattgcttcctgtgatttgagtgtaaaattgttgaagttcataatcatgatctctttgttattgatttgtaattctatatatagttattgtaagccattcatattttttctaaagagaacggatccactaaatatcataaaatagggtacattttcaaaaaaacccaaaatattgatataaaggtttttttatgaaggggagtaggataggtacaaccaactctcagttctcttcagattctgtgattttcataaaccgggtaaactggtagacctctggtatcctccctttctcccaattcttccatttccatcgcaaaaggatgtatgacctcaaatattggagataaggacaaatagctagtaaagacggacattaatagatacattgataaacgtccggattatcactagttatccatacccacaatattaatattatcaatctccataaggataaagtaagggacatctcatggggaaaaaccctaagaaaatactcattatcgatgacgaagcggtattcagagaggcaatgacacgagcgctgacctcttgcgggtatcggtgtgttccagaggaagatccagcgaaagggataatgagactgaaacgagaaccatatgatctggttctccttgatatcatgatggaccctgttgatggatgggataccttagctcatctccgaactttctcaaatggcagagaaacacctgttataatggcatcggcgaaaaaactcaatatcgacgaggtcatcaggtatggtgaatatcttgcaggttttgtcgaaaaaccatttgtagatacagaattctgtgatgcaatagatgaattctttgactggtatgatccccttatagcaaacgcaaatgctgcacgattacagggcgtctctccggatatatgtacttcctggattcgtgttgggaggcagataaaagcaatcacccagatgttggaatatgtgaatccatcctgcatacctgacgagtcaatgtcagaagatgaatgtatggaccggcggatggcccaggttagggagatattagaaagaaagaggagagagcgagacaatataaaaattctctatccggttttttctatttaggtacatggtttttccagatgagtatcatcaaataattagattagaatttttctctctttaaggagaggagggaaggggaatcccttcaatcccaaagaaggtcaacctacccatattatctgaagaagtacataaccggccatcatccaactttaactcgaaagttccaggtggggctacttctcggatataatcttccatgacgacacaattttcgcatccttctgctttttcatcctcatcaggtttcaaagtacccctgtaccagggttttccattccaatacaatgtatatggaatgctgccagactcatcaggtttcattgccacggtacttattttaaatacctctgaataatccatttgagaggtttttgcatgaacttcctgaatcgtgcagcaatctttacatggctctttttctcctgccaggactgctatcttatagacaggttcagttcttttaggtttaacttccccacctgtatctggaacctcaactacctggtcttcatatccatcttcatgttcaaaggttaggagatatttccctggatctactccagttatcagtaagggagtcaatccttggggttctccattaatgtatacctcaatattttcaggctgttccaagaggttgatcgaaccattcacaatttctattgattcaatttgggatggttcttcaggaattttgcttaataatccttcatccggatttggagtaattattggctgaatttctggagtgacctcttcggtaggttcaggagtcaacgtaggctctggagtgacctcttcggtaggttcaggagtcatcgtaggctctggagtgacctcttcggtaggttcaggagtcaacgtaggctctggagtgacctcttcggtaggttcaggagtcaacgtaggctctggagtgacctcttcggtaggttcaggagtcaacgtaggctctggagtgacctcttcggtaggttcaggagtcatcgtaggctctggagtgacctcttcggtaggttcaggagtcatcgtaggctctggagtgacctcttcggtaggttcaggagtcatcgtaggctctggagtgacctcttcggtaggttcaggagtcatcgtaggctctggagtgacctcttcggtaggttcaggagtcatcgtaggctctggagtgacctcttcggtaggttcaggagtcatcgtaggctctggagtgacctcttcggtaggttcaggagtcaacgtaggctctggagtgacctcttcggtaggttcaggagtcaacgtaggctctggagtgacctcttcggtaggttcaggagtcatcgtaggctctggagtgacctcttcggtaggttcaggagtcaacgtaggctctggagtgacctcttcggtaggttcaggagtcaacgtaggctctggagtgacctcttcggtaggttcaggagtcaacgtaggctctggagtgacctcttcggtaggttcaggagtcatcgtaggctctggagtgacctcttcggtaggttcaggagtcatcgtaggctctggagtgacctcttcggtaggttcaggagtcatcgtaggctctggagtgtcctcttcggtaggttcaggagtcatcgtaggctctggagtgacctcttcggtaggttcaggagtcaacgtaggctcaggggtgacttcttcacctaactctggagtgactgttggctctggagtaacttcttctgtagattcaggagtcaacgtaggctcaggggtgacttcttcacctaactccggagtaaccgtgggttcaggagtaatctcttcgcctaactccggagtgaccgtgggttcagcagtaacctctttaccgaattccggagtgactgtcggttcaacagtgacctcttcggtgggttcgggactgaccgtaggttcaggggtgacttcttcacctaactctggagtgactgtcggttcagcagtaacctctttaccgaattccggagtgactgtcggttcaacagtgacctcttcggtgggttcgggactgaccgtaggttcaggagtaatctcttcgcctacttcaggagtgactgttggctcaggagtaaactcttcaccgatttcgggagtgaccgtgggttcagcagtaacctcttcacctacttcaggagtgaccgtgggttcagcagtaacctcttcacctacttcaggagtgaccgtgggttcagcagtaacctcttcacctacttcaggagtgactgttggctcaggagtaaactctttaccgatttcgggagtgaccgtgggttcagcagtaacctcttcacctaactcgggagtgactgttggttcaggagtaacctcttcgcctaactccggagtgaccgtaggttcaggggtaacctcttcgcctaactccggagtgaccgtaggttcaggggtaacctcttcgcctaactccggagtgactgtcggttcaggggtaacttcttcaccatactccggagtaaccgtaggttcaggggtaacctcttcgcctaactccggagtgaccgtaggttcaggggtaacctcttcgcctaactccggagtgactgtcggttcaggggtaacttcttcaccatactccggagtaaccgtaggttcaggggtgacttcttcacctaactccggagtaactgtcggttcaggggtgacctcttcgcctaactccggagtaactgtcggttcaggggtgacctcttcgcctaactccggagtgactgtcggttcaggggtgacttcttcacctaactccggagtgaccgtgggttcaggagtaacttcttcacctaactctggagtaaccgtaggttcgggggtaacttcttcacctaactccggagtcactgtcggttcaggggtgacctcttcgcctacttcaggagtcactgtcggttcaggggtgacctcttcgcctacttcaggagtgactgttggctcaggagtaacctcttcaccgaattcaggagtgactgttggctcaggggtgacttcttcgcctaactctgaagtgaccgtaggttcaggggtgacttcttcgcctaattcaggagtgactgttggctcaggggtgacttcttcgcctaattcaggagtgactgttggctcaggagtatcctcttcaccgattacgggagtgaccgtaggttcaggggtgacttcttcgcctacttcaggagtgactgttggctcaggagtatcctcttcaccgattacgggagtgaccgtaggttcaggggtgacctcttcgcctacttcaggagtgactgttggctcaggagtaacctcttcaccgaattcaggagtgactgttggctcaggggtgacttcttcgcctaactctgaagtgaccgtaggttcaggggtgacttcttcgcctaattcaggagtgactgttggctcaggagtaaccacttcaccgaattcaggagtgactgttggctcaggggtgacttcttcgcctaactctggagtgaccgtaggttcaggggtgacttcttcgcctacttcaggagtgactgttggctcaggagtatcctcttcaccgattacgggagtgaccgtaggttcaggggtgacttcttcacctaaatccggagtgaccgtaggttcaggggtgacttcttcaccatactctggagtgactgtcggttcaggggtgacttcttcaccatactctggagtgactgtcggttcgggggtgacttcttcaccatactctggagtgactgtcggttcgggggtgacttcttcaccgaattcaggagtgactgttggttcaggggtaacatcttcgcctaactccggagtgaccgtaggttcaacagtgacctcttcgcctacttcaggagtgaccgtaggttcaacagtgacctcttcgctgagttcaggagtcaacataggctctggagtaacttcttcgcctacttcaggagtgactgtcggttcaggagtaacttcttcgccaaattccggagtaactgtcggttcgggggtaacttcttcaccgatttcaggagtaaccgtaggctcaggggtgactacttcgcctaattcatgaatgaccgcgggcgtactagtaacggtgggcattacagtcggagtggcagtcctctgactgttgacattagcattgtcattcaatttcccggaattgccagtagtgattacgggagtagaggttggagacacagtggctacaacaactggtgttggaagagtgaccacgggtgtacttgtaacggtgggcattacagtcggagtggcagtcctttgactgttgacattggctttgtcattcaatttcccggaattgccagtagtgattacgggagtagaggttggagacacagtggctacaacaactggtgttgtaggagtgaccacgggtgtacttgtaacggtgggcattacagtcggagtggcagtcctctgactgttgatattggctttgtcattcaatttcccggaattgccagtagtgattacgggagtagaggttggagacacagtggctacaacaactggtgttgtaggagtgaccacgggtgtacttgtaacggtgggcattacagtcggagtggcagtcctctgactgttgacattggctttgtcattcaatttcccggaattgccagtagtgattacgggagtagaggttggagacacagtggctacaacaactggtgttgtagttgtgaccactggaatgacagttacaactggctcgacactggaggtcttttcagattctggtttctctttcttgtccttatctggcagtaaaacctgagcaccgggcttaattccagttgtaccgtcataattcggagtggcaagagttgcaccttcatcagtgatctcctgagaaccggaaggagtagtgacctgggctcctttcttctccttatcttcctcagtctcctgaacggtaacaggagtcggagtgacatcaggactaatagttacaactggctcgacacttgatgacttatcagattctggtttctctttcttatccttatcgggcagtaaaacctgagcaccaggcttggtaccggttgtgccgtcataattcggagtggtaagagttgtaccttcatcagtgatctcctgagaaccggaaggagtagtaacctgggcaccttttttctccttctcttcctctgtctcctgatcagggacaataatcggggtggcttcgggactgacagttacaactggctcgacatcggaagccttttcagattctggtttctctttcttgtccttatctggcagtaaaacctgagcaccaggcttggtaccggttgtgccgtcataattcggagtggtaagagttgtaccttcatcagtgatctcctgagaaccggaaggagtagtaacctgggcacctttcttctccttctcttcctcagtctcctgaacagggattatagttgacgtgggctcaggactaacagttacaactggctcgatatccgaagtcttttcggattctggtttctctttcttgtccttatctggaagtaaaacctgtgcaccaggcttggtaccggttgtaccatcataattcggggtagcaagagttgtaccttcatcggtgatctcctgagaaccggaaggagtagtgacctgggcgcctttcttctccttatcttcctcagtctcctgaacagggattatagttgacgtgggctcaggactaacagttacaactggctcgatatccgaagtcttttcggattctggtttctctttcttgtccttatctggaagtaaaacctgtgcaccaggcttggtaccggttgtaccatcataattcggggtagcaagagttgtaccttcatcggtgatctcctgagaaccggaaggagtagtgacctgggcgcctttcttctccttctcttcctcagtctcctgaatagggacagtagtcggggtgacttcaggactgacagttacaacaggctcgacatcagaagtcttttctgtttctggtttctctttcttgtccttattgggcagtaaaacctgagcaccaggcttagtcccggttatgccgtcataattgggggtggcaagagtttgaccttcatcgctgatctcctgagaaccggaaggagtagtaacctgggcacctttcttctccttatcttcctctgtctcctgaacagggacagtagtcggggtgacttcgggaatgaccgttacaacaggttctacctcggaaatcttttcggattctggtttctctttcttatccttatcgggcagtaaaacctgagcaccgggcttagtaccggttgcaccatcataattcggggtagctagagttggaccttcatcggttatctcctgagaaccggaaggagtagtaacctgggcacctttcttttctatttcacttacaggctcttcaacctgaagcatgaacggagaaattccgctttgaaactcttcttccagtattgagagagattcgccaaaaattgctccattggctgttgaaaattcaaagttatcctgctctatttcattttcactcttttcaacaatcaaaaccggctcaatcgtcgatagagcttctattacagggggaccctcttcggatgccagtccttctccaaatatcgccccattcgcagtagagagctcaaaatcaatatcgaaatcagcccatgaaccaaaaaaatcctcttcaacagactcaatggaagaaattgattcaaattccagcaatccttcttcctcattcagtccgaccccataaactgcaccattagcaagagagatttcatactcaagattttctacaggagcagtatcagtttccggagcgggttctgtttctggagaaggaactggttcatcccagtcgagagattcggaaatatctatctcctcccaatcgactggttcttcaaactcttcctctattaattcattccaatcaaattgaccttcaggttctattggttcgggcgtaggaacatcagtaaaattatcagcacatgcataactaccgattaataaaaataagaatattaatagcggacctgataatttgtaataatttattttcattttggtcaccccttccgtttcctttgccatcatcctatttgtctattcatttctgtagaacttacttcgaataaaaaaattatcattttcacacgatatgaccatgggatagagagatttcatgatacaaggttggtcatggatggaaaaacaagaggatgaaatctcataaactttcgataactgttagtaggctatcaatccataaatacatatcgacaatttttgaaaatttgctaaaaatgagctgaatggtttttaattatttatttttatattatctttttattgctatgtgagcgatatgaatttatatgacctattctaacaataccatatgaaagtaataaccctgtttgcgacattatttttttttgcgagtcttgtggtaacagggactactgttgaaatagacacagacaacccccctgaatggaaagaagggtattttccaacgtatccattggatccacagattacctggattggaaatttatccctggaagcaggatatccccttgtcgatcatgcatttggaccgtttactgaaaaagactgggagatgtatggtgttggaaaagaacatgtcattcgaataattgcatacgaaaacccaccactcttcccaaacaaaacagcatatgcgatttatcatgaggggattgaaacgatgccatggttaatcgagatgaaaaatccggtgactggagatgatatgttggctcaggttgcttcaacccccaagggaaaatataatcctaatttaactcctcatgaaaatgatcttgcaaataatattggctggtatgttgttgatggaacactatatccacgaacctggataagtggtcacttggcagaaggacagacctgggttgagtactgggggccatttaatccggacaaagatggatctaaactgagaaaaagaacctataccatatcagaagaacctgttccttttgctggaaaaacgtatgatggctataaggtaagaattgtcggacctcatgttatcgcaaatgtaccagtagaatcagttgaggaattaaccttggtagacggtatcggagtcacatcacggttattgacgcacactgcaaccgaaccatttgttagaaattcgtcaatcaccggaaaacaaacaatgccgaaaggaactatgatattccgtcatctggtgacgatgcactcaatggagaataaaacatcataaatgcttttttatatattatcatttatgaacaaatgctaaaaaaggaaaaacacaataaaagaacatacagaatcgatcaattatcaattggaaacctaatcatgagaataagaagaatatcatgaaaataatttctgtctgtttattttttttagtaggattaaacctctttttttttgccagtgctgaccgattgccaacagaaactgatgaaaaccagatattttctattgatactgaaatcaaagcaattggaataataagtgaggagagttcagttgactggataattgattatcagcggttgtttgtgaatggaacatacgattatggaaatatccatgatggaaaactcaatcgaaccgagagcattgcaatactccaatgggatgattcactccgtagttctggcgggagtatcgcaatgggtaaaaaaatctcctataattcgaaaaataaggcatcctcgcgatataatctgcaagctgaaaaagttctgacataccggacaaaagaaggatcacatcttttcggtgaggagtcgtggtcgctcgatgttgctggcgactgggatctgaagcgtgaaaatatccgatgtgtcttcgcagatatagaaccgaattatttccctgcattctgtaccattgtcaaagcaggaagcagcattgtaaatctgaacaccggacaacttaccacaaaaggagtatctagagcggtgacgtattatgcacaatacccggcggctctgaattatctcatagcagtcagaccagattccagcatgaatagtccggcaacgggcacgattaagacaaactttggaggggccattatggaggcaaggaatcagtccaataatgtttctgctacgaattcctggaaagactcaacaactgcaaccggtggaatagagaagttccagaagaaattcacctatgaatcgggattaaaaatttgatttatatggaaagggatcataagaagaaggatcgataagaaccctgattctatttttttgagggcataataactcggatatctcacagagcagatttcttcaggataattccactataaaaaagggttcaggtaagacctcttcccaggtagatcccagacccaacaaaccagtcctcccctgccggaagaacataacagagtttcagttcattgttccccgaatccggattgtaatacacaacataaacaaatcctccaccccgctcagcagctcgtacctcctgagttattatcggaactccatagacatcagttaagttcatccggttcgtaccaataagttcaggctgatggggaagagccagggtagtcccatcatacccataggcaaagatgtatgacccgccatctgcaaaggactggttcaggtcattaaagtccataatcgcttgttcctttccgaccagatctgcatgacggacggcttgtctcaccctgcttataagggcatcaatctcttcagatccgaattctgcctgaatccaagggatatataatccggagccaataaaccagtctgaatctaccggttcaacataatagattttcaactggttctgaaaatcctgatcaggattagggtaaaccccatacataaagccccctccttgcccagcggtatcaatcagggcaggcatgatggaaaagccattcatatcgaaaagatcaggccgatcctttcctaacagtccctgctgataaggtagggcgagggtggtactattcatcgtataagcaaagatataccgatctccggagacatatggacctgaaagattgttaaaagcagcacaggcagattcctgccctgttgtccgcgcaaatatggctgcatcctgaacaaactgagtgagattggtcaggcttgcattcagattatctgaccctaattcctggtcttcggcccccttctgtttctctgcctcttctaggtttctgacgacagctactcgccattcctgattatcaagggaaagggtatcccagattgcctgacgggggacctgtcggttcgagtttttatcccagaacgtataggtgacggttccatcctcattctctagtacagcatgcgatacatttcgcatctccgggatatcatagatgggatcggtcaggaaatttttcccaacctcaaattcatttgttgcatagaccgtcataccatctgtctgaaggataaaaacttcatagccggtctgctcagtaaagggaccgataaccggtctgaagaactcttcaggacggatggtaacatcagtataaccaagatattcatcgccttctgaaaaaatgggatagctgatagagattccataaaatccttcttcaaggtagaaaatattgcttatgactggttcttgtctttcgttcgcaaagctggtttctggctgataactcagatcagtaccgataagacctgaaaacgtgaccggagctgcagcagtaacgatattatctggagaaataataagagaggaatgtccatagtgaacggattctaactttctttccaatacagaggttgcattttctcccgatattccaatggtccggagagattcagcacttttttggttctcttctctgataattgccagatcattcgatatctcaccagtaattcgatccagtgctgaaagcatatccgaagggggaaccaggttctggtttaatgaagaatctggggcaatatcatctgcatacgcgggattcagaaagatcaatatgagaaagatgagtacggaccatcgtttcatactcatccatcttctgatcaggagataaaaacttcgattcagatcacagggatgaaaaggacatgtgggcataaatgaagattgaagcccatatcatccggaaaaatgaggaggctccccatgtagattataaatgatgcagccatttccatatcgtttggctacccaaaaaattttttttcccaattccctgaacgaaggttttcatcatttcacgtgcaaagagggaagtatgacgcttgatcacagggaaggattcgtggaatttcaggggcgaaatatctggttcagaatggatggagcacgtaattccgggattccacttctcattcttcatggaggaccgggtgttccccatgattaccttacccccctctcggccctctctggagatcgaccggtcatcctatatgatcaactgggatgtggaaattctgataaaccaacagacgtatcactgtataccctggactatttcacgcaggaacttgaagcgattcgccgggcacttgatttgaaagaagttcatattctgggtcagtcctggggtaccatgctggcggttcattatatcctgactatggatccgcagggagttcgttcacttatcctatcagccccctgtctttcagcgtcccggtggcatgatgatcaacgtcggtacatcaatgaacttccagcagatgtccgggagataattctgacaagtgaaagagagggaacctgtgataccccggaataccaggaagcgatgatggtattttaccggaaacatgtctgccggatggattcctggcccgaatgtcttcaaaagtccatggaaaaaatggcttttgatgtgtatgaacatatgtgggccgagtgaatataccataaccggaactctgaaaaattatgagcgggctaatgacttaaaaaacataacaatacccactctctttacgtgtggccgttatgatgaagcatccccagaatcaaccacgtattatcagagtatgctcccaggctccagaattgtcatttttgaggatgcatcccattcccaccatcttgaacaggaggccgcatatctcaatacggtcagggaatttttgtcatccggagaatgatgcttatattgttcacattcccatgtatcatttccttggccttccctgggagttcttattgaatccaaaaaaagtaatcactttccgaaggctgccataaacaaaatccgattcacttcatcccggcatttcagccatcggaacatgagaggctgggacctcataccaggtccactctccgtcagacaatgcaattttttctttaacagcatgagaaagaatggagaaattactgtttgaacaatacacatgcgtttttggtattgatgcaatcgtttggggatcaaatacaattctctacataggggggatccgggacaaaacccgcgtatgatgagggatcctgaccgcctgaaagcatcatatcataaagcgattgtccggattccgggtatgctgcatcaatatagaccaggtgggagattttttcaggcattctggctgcaaccccagttatgatcatccctccataactatgaccgaccaggataatggtatccagatcatgctcatgaacaagcgaacagatctgggttatatgatcagtgaggttggaaatcttctcatctccaagggtgggagcatatccctgaatgccctgatcagcaagggcagatagtgctgtatcccagatcctacctcccatcaggccatcggaagtatgtaccggatctcaggtggtgcgttcattccaggcctctgtggatatattccccccatgaacacagatgaatgataccatattgtctcctgtatgcattcaatgatgccttcagttatataaatcggttttgattccccgattatattcaaaatttcccatcggattattttcatgtggaaacctgaatatcaaacactgaatatggggaagagagtgagtgagtgatggcacttgattatgagagaggaccatctggcatgaaaaaaacaacctgatttcagaaattgggtcaatgaaccatagatatagtgctcattactaatgagaaacgatatatcattttactaattagtaattagtatggtttctaaggagcttctgagacatctggttcgccagcagaagacacggattgatcagaaagatgattcagttcgccgtaatatccttgatcagctccttaattcgtttgaggataaccgggtaatcattcttaccggtattaggagatgcgggaaatcaacgctcctgaaacagatcatgcagacaaaatccactcctgttatgtgaattttgatgatgaacgactccttacatttcctgcagaagagttcgaaattctaaacgaagttctgatagaggtatatggaccatctgatatctatttttttgatgaaatccaaaatattgccggttttgagacattcgtgcggcggcttttcgacgagggaaaaaagatagttatcaccggttcaaacgcatcccttctcagcagggaatttggaaccaggctcacagggagatataaactcttcgaaatatttccattctcttttgctgaatacctctgctttcaaaaggtaaacgtgagaaaggactccctgtacataccaaatgaacgggtcaccctgattacatcattcgcaaaatatgttgagaatggtggaatgccggaatatctcattcattatgaccctgaatatattaaaacactctatgataatatcctgtatcgggacattattgccaggtatgcaattcggagacaacgactcattcgtgaactcgtgggaattctgatatcgaacatctcactcccctttacgtataactcacttaaaaaaactctggggctgacaaatgccattacagtcaaggaatacatcacctacctgcatagtgcgtacattttctttgaactgtctcgatttgattattcagtaaaaaaacaactcaattcaccaagaaaatgctattgtattgatactgcatttgggatacttgggggtttctcactttcacctaataaagggtggcttttagaaaatattgtctatgtggagctgcttcgacgcggaatggacgtgtattattttcaggaaaaacgagaatgtgattttatcacaaaagatggcccacatattactggagcacttcaggtatgcttcgaactgacgaatgaaaaccgggaccgggagattggagggatattggaggctatagaattctttggtttaaaagaagggtttattctgaccaacgatgaagaggatcttctggtaatgggtgaggttagaataattattatgccagtctggcggtggctcctgaactatattcccgagtaaaaaagaatggatctgttatcctttctattaccgccccaattatataacaggttatttcaagtccatttcatgtcccggtattcatcgaatgccagagggttcatcattcactctttgaacaccataatctatcacttaccaatcaaatatcgatataaataacttggatattaactcatttactaagcagcaatcataacagttatagcacatggtcgaattttaaaattttctatgcataacatgaatgaaaaattgagattcaagattcgcgatttattgcttttcgcgtgaaatttatacacgctctccatgaagatgatgttccattttattttgccaataataagggggaaaaattgacagaagagattgcttttgataaaaacaatgatgaatcctatggaattagctcattggagattatatctccaaatgttgctctcaaaacacttgacaaatcaactttttttgcaggtggcctagcaatacctaaaaagtcgtataaatattttggaattgaaaatttacaatcaaatcagagaaaaccaaccacaataatctatagaaataaaaaatttgaagcatattttactgcacaaaaaagttacaaggctttacaatattataacgacttcatggtagaaataagaaacaaatatccctatgctgcgaaaaaattaagagaatatcgagggaaaattgacaacggcccaaaaatggaaattaccataaatcttgaaaaaaatgaattgaacattgacttcattggagatgatattatgaatgattacatccccttttcttcagaagactttttaaaacttttttcagacattaaaaagttcgttgcgcaatctcattcgcatgatcttaccacaaaaagttatattgaatattttggagaattccaagtaacaaaatcatttggacaaggaactcctgctaaggtttcatggttatcactaagtgtttcttcagaacaacagaagcgatattttgtttctttttattatgataaattcggtaaactttttcttgttctaggcattaaagaagacatccaagaaaaatacgattggcctagcgatattcaaaaaatttatccaagattttctgacattaatgtatctgatgcaatagcaaatcgatatccaaaatcaagaattttcaaagaattctctgttgatattaaaaatattgatacctctttagaggctctcaaagaggatatagagcaaagcctctctaatgccctacaattattatttcaggttattaatagcagtgaaaaacctaaaattatttggagattgtctccgggtaaaaagggaatttattgggaagaatggagaaatgcgaatatttgttctttaaacatacctgaatacaaaccatatttcaatgaactggaccaaataactgacagggactcatttaaaactcgcttgaaagaattagcaagaatagttcatcctgaaaattcaaattttgatctctctattagtcaccaaaatacaatttggtcttattttcatgaaatgaaaatcggagacactattatcgcatctactggaaaaagtagaatatatggcattggaacaataaaatcgaatgtcttatttcaagattctgaagattgtcctgtgattagagaagtgcattgggaatatgatgatctaaatattccgatcccttcagaagtaagtggtaattttcttagtgcgttaaataaactatcattagatgattactcaaaaattattacatctattgagagcggtttttctactaatctagattcaataattcagttattagagagaaagggacagattatactttatgggcctcctggaactggaaaaacttattcggttcaatcattaattaaaaaaacagcatcaacaccctatatatcaactacaaaggattatggaaatatccaattcttttggctaattacctataaagacaaatatgacgatatttctacgataaattctaaatcaatttacacctatcaatggaaatcaaattataattattccaaatatttctacatgattaatgagggagactattttgcaatttacctttgggatgagaataaaattattggatatgcaaaatgtatcaaaaaagatgaagaatcttttcaatatcaatttatcaccttacttgatggaccgaaatatggaatacttaagtcagatcctgaatttagcaaaggaaagataatccgcaccaaagggaatgcacgcatcaccatattagagaatgaagaatttgaaagactcattttcctttctggaataaaatatgaagaattaggaatcaagataactggaaatgaaattattcaatatccttcagagttcattacatttcatcaatcattctcctatgaagaatttattgaaggcttacgacccataaccgatgcggatggccggatcagttattcggtgaaagaaggaatattcaaggatttatgtagaactgcatacaacaccttacttacgcttgcaaacattgataaaaggtggaatgaagatcaggacgttccacatctgactgatgaagagactcaatatgcactttctctcgcaccaaaagtcccattttaccttgttatcgatgagattaaccggggagatatctccagaatctttggcgaactcatcacattgcttgaaaaagataaacgcttacttgccccacatgagatcacgacaaaacttccctcatcccggacgagatttggaatcccccctaaccttttcctgatcggaacgatgaataccgctgacaaatctattgccctcattgacatcgcattacggagaagattcggatttattgaaatgatgccggattatgatctcctctatcggaccttatccagcgatgatgaaagtcttcttgaagtatattccatcgcaattgcactccttcgaacaatcaatcaaaggattcttgaagagcatgatagagagcaccagatagggcatagtttcctcctgaaactcaaagatgccaggacaagggaccaggctatatcagaattgtccatgatctggtatcatgaaatcatccccctcctccatgaatatttttacgatgctcccaggaaattattcaaggtcataggacctgagtttatgaagtcagatccaaaatgcatctacttttacccggaaaaagaaggtgaatccttcctgtctgcatgcaaatcgatctcaaagggttatgatctgaatgggttatcctccactgacgctctttgaatgggtggaatatccggtcaccattggatcccacccaaagattactgatggagttctaactcttccccaggaattttttgatattctggatgaatgtgatccaaagcagcaaatatttgcaagaacgacaaaaacgcttacccccatcaatatggtaggagtaattcggattggtgacgtaactatccagattttaccaaagttatttcgcgaccatctgaatgagcataaagggaccatatttcgaaaccttgcagtcatgctcagttataccaatctcaaacccttatcgagcgatcttacatccatggatcaggaggatatagacatgcttgaattattcctccggatcttttcagagcaactccaccatcttctctttcggtgtcaacaccggcaatatctgaacagggatgaacatctgaagtttattaagggtcgaattcaggtcaataaatattggaatcccgcacagttggagagaattccctgcacttttaaagaactgacacaggatactcttctcaacaggatctttaagttttgcgccactctgatgtcccggcacacacaaaatgaggagacgaaggagcatctaaagggaattttacagatcctggaaccagttacgtatactcatgttacctcatcagaaaccagattcgtcattcttgaccggttgacagaacagtttgcccctttgctccggttttgtgagatttatctcaggcatagcaccattaccttacaggcatcacaggttgagatcttctctcttcttatcccaatggaaagagtctttgaacaattcatttcaggagttttatcagagcagtcacacctccttcctgaaggagcaactgtttattcacaatacccagggggacatctcgctcaaacccttgacggaagaggtatttttgaattgaggcctgatatctttattgatcatcctcgcattccggtcatcattgacacgaaatataaaatgcctaaaaaatcatcttcgaattctggtattaaacaatccgacatttaccagatgtttggatatggagcgaaaaagaatgttccagccctgatgctcctctacccggacattggagagaaaattgatattgacttggaattttcatatgacaattgccggttatctgcattattgatacggtccataacactgacgtatgatctcgctgacccagtgcaatgggaaatgtggttagaggaactgagaggaattatgcatgatatgtatgatcgggcttcccactatgcacaggtggatacatcaattccagtccagatccatgtatgacatgaaatcctattgaccacgattaacccataatttttacagatttttacttttttccgcaatcatctcaatctcaaccagtgcccctttcggaaggctcgccaccccaaccgttgatcgtgacggagtttcatttcccatatagccggaatatatcgcattcaccgtcggaaagtcagagatattcgtcaggtagatatgagtattgacaacatcatcaaactccagccctgatacagcaagaattgcccggaggtttttcataacctgatgagtctgatcctctaatgtatccaggagaactcccgtctgtggatcaatcccgatctgacctgatgtatattcataatcattcacggcaaccccctgactatacggcccgattggttttggagcctgatcggtgtagatagtctccttatgtggcatattgatcagtaccataatcagactcataagaaccattccaaggataatacatgcaattgcgagcaggaaagtatttttatcgtttttcaaatccataaagaatgtcatatttctttcataatatacatactctgtcactcaagaaccatgcagaaatgatgtgagtatcatcatatcagaaaactcatcatgaaaagggatttatctaccggactgaagattttcagttcattaggagtggagaagggagtaccacagaaaagactatctggatgcatcgggatcaatactatgattgattgtttcattgccataattgtgtatacgaaccaatcaaccaaaccaggggaataaaggtaattccatgaattatcaggatcaatccggtattgacgggatcaagacagaccatctcctgtagaaagatccggtaaaacacagcaccccggtataccgaaagcagcacaatgataatgcttaacagatggagaatacccggaaccctgtaccacccagtggtcaaaaatggattctttgaatgtttctggtgataccacaggagcattgattaagaattcccaaaagccaggaaagaaagacgagaggcgaaagattgaatttgaagacctcaaccaaagaatacatgaaaaggagacagattaaaatgagaagaactacccctcaaaaaaaaccatcaacctaactggtattcaggagatggggcataatttctgatgttgcatagacgaactgaacctcaggctgcataaacgtcagactcacaacactaacgaaaaaaagacatatccaaatactagagagataaggataaggaaacagatcagaggaagatacctgatcctcatttcaagtatagccctaatccatatttaccagtactctcatctgaagtatcgtcgcgtaacatgcaaaatatcagaaaaaattcatgaaccaacgatattatgtcacaaaagcaaatattttattgattgagaactgacactctgatttaaaaagaaggctaaattaagataggccgaggccgtttgatagccagtctatctcttcactcacctttctcagctgatttggatacgttgtcatatgatgaggctgatccttgaagagaatcatccgtacatccgctttacttgccatcttatatgcccggtacgtggacagagcacttgccggagcaacagcattatcctctgttccctgaagcataagaagaggagtctgtacatgctctgctttatacacccccatgatcggaatataatattcaggattctcaaagggcgtatattcatgatacatcaggttcatcacaataccattggtatttgagacctgtgagttctcatctgcatatccggcaccagcaaccgctaccttgagggatggatcctgggtaatccaatagagagtgagaattcctccatttgaccatccggtcacaccaacccggttcttatcaataatcccctgttctgagagatattcaatacccttcatgaaatcttctgtcgggtaatcgtggatatgaccgccctcaatggactgtgcaaactcaaagccccagttactgcttccatgataattcgtagatagggtaattgctccccggtcggtgatcagatggtacggaaactcccaggtatcacgccaactgtcaaaatcagtatatgtcggtccgccatggattacaaagacgagcggatacggtgttcctggtgtgtaacccggagggaaccggagaataccctgaaccgtatcaccccttgcaccggtccattcaataacctccgaggttccgagcggtttcttcagaaggtcttcattcaggcttgtcattcttttcagattccgtatctcccctgcgataacatccgctgcatagatctgtggcggcactgatgctgaattaaaattatagaagatccgtgaaccatctctgcttgattccagggcaaagatgttcccctgatgctcaccggaaagcagggtctttgtccagcccgtatcgttcttatcataccttgccaactgtggatttgttccgtcagcaagaaggacatacacacctccgtcaaaaggtctcatctctacatcatcattgaagagatctttgtgcatttttttctcccattggagagggatctcttccaatatccgggttgcaggagtatataccacgatatcactcgcatacgaaacaggatatcgaaggccgccattcagatttcgtccgatatagaccattgaactatccggagaccaggcaaactcattctcatcctggtatccctcaatacgggtcatgacttcatcttcagtcccggtcgtcgtgtcaagcacataataggaaaatgatggtttctctgtccagacttcaggatagatggacgatttatatgcaatatacctcccgtcaggagacggatgatatgcgtagataatatcagtattggatgtcagctctgttactgctccgctcctgatgtcataggacttcaaaatcaccgggtcagggatctcatccatgatgatgacatcaccaggccgggtatcctccggagtatcaggagaagctcctgcatataccagagaatgatctccgagccatgcaaaaccggagaggagctcatcagataccttttgtttcttctcccgctgcatcgtggagagatcaaggagagtcaatatctctttcccgccattccggggcattgatgcgtaggcaagaagcggtctcaatgaagataatgcccataccgtaaccgattcatcaggaccggtaagggtgaccacttttccggttgatgtattcaccatcatcagggtcccgttatcagccgggggtgtaaaatcatctccggttatgagcatgaacacaatattttcttcatcagatgtgagtgcaaaatgacgaagagaatccatcttcaggatatcatcataatcgagatttccaaaaggctcagctgaaacaaccgggaataccaccgctccacaaccaattattaccatcaggataaaaattacgttcagtctggacatgccataacctcggtttcacgataatacgataccttccaccctaccctcttgttgagtgatacattactactccatcatggtatcatttataagtatcagggggagagggatctcatatttgaagaccttatcaccatataaggttcaatcgtcagatatactgcctgaaaaagaagagtttcagtccgaatccgctcaggttcaaaggatcggaggagggcatcccctgcaaccaggccatcgtattcagccggaaggcgtaaaattatatgccaaagtgtccagaaaaagactttcccaaaccggcgggggcgtgataaaaagtaatattttcctgaagaaacgagatctgccagaaatggagttttatcaacatatacatagccaccagtacgtatttcggagtaagactggataccgatcggaagtttatggagtaccatgcacgttttggatgatatagaaagtatgagaatatatcagcttgcaatgaagaaccaaagcaaactccaccatggatgcacatacaccattcacagaaccatggcattacccatcaggagccagaattagtactcacaagaaaaagggtactggtcagtatcctgaaaccagggtcccaatccggtcaacaaactgctgatattctcccagacttcctgaactcaatgcctgctgtgcctgcttgtacagtccagatatctgcccgagaatcgaggatgactgatcatcacccggttgttccactcgtttggtgatatcctgcctggcttgtcttcccccaaagatgacctgcaaagcctcattcagggtgggctgcattgtcagcttatccccgtatgatacaataacccgctggagctggggaagagttcccttctgagtcgcttcaagatagaggggttcaacatagaggagggactgctcaaccggaatgatcagggtattccccctgacgacggatgaccctgcctgtgaccagagcgtaatactctgtgaaatatcggtatcctggtcgattctcgcttcaatctgcatcggcccataggtcagctcctgcttggagaactggtatactatcatctcaccatatcggtcaggatcacatctcactgccatccatccgatgagattctgcttatttcggggtgtgaaaggcagcatcaggatgaattcctctctctcttcacccggcaatttcatgattacatagtatggttcaaaccgctgctgcgttttccgatagatctcatcaggaataacccaggcatcttcccggttgtaaaagacacggggatcagtcatatgatatattccataaatttctgcctgaatgttaaataatccatgtggataccgtaaatgggaacggagatcatcaggtatatcatcaaccggacggaacagacctgggaacatctttgcataggtctgaatgaccggatcatcaggatcaacgatataatacctgatatctccggtatatgcatcaacaataacttttacactgttccgtacataattcatggatttggcagataattcccccgttctgaccggttctgaataggggtaccgatcagatgtggtataggcatcaatgatccaggataattttccatcactcatgacgacatacggatcagagtcataggtaaggaagggagcgattttagaagtccgttccagaatattccgatacaggtgaagtttactatccggtgtcaaagagccggaaacaaggagctctactgatcccaactgaatggcatacacgagccggggaaggagcgaaagttcgacccctgcattcccgtcatacaaactatagatgttttcatcgccggatgggtaatcaaactcttcagtccgggtattggtaatgcaataagggatgtctccttccccatagtagatctgtggatgatcaagggaaagggacgggaacggagatgatggcggtatatctttaacaaaaaattcaggaagaccattggtcgttatccggtcaaccggactcataaccgccccatacccgtgggtaaaaacaagatgacgattcacccaggtctgtgcctgctgtggaagattgtatgagttcatctcacgggcagagatatgcacctgtttataattgccatccagccaataccggtccacatccacgtcattgaaggtataataggtcctgaagagttggagttgttcaagggtcgttttcatcggcctccagtcccagagacggatatttgatattgtggcattattattcctgatatctgtttcagtgaggttgtaaagaacgggaaaatcccgtgcattgatatttgcaagattgtatccgtcaagcgtgctgttgatattgtatccaagatacgtccgttcaagattgaattcattcggttcaacgatgagggtctgaaccagaaatcctgccccggctgaaagaatagcgattatgaaaaatccacctattccgtaggctatcatctccgaacgctttatcttctcattcaaaaggaagagaagcccgataaggaaggctatgacggtcaggatagtgagtgcagggatggttatggtaacatcggtatatcctgcaccgattacagtccctttcgaggtatacaaggttgaatatcgggtaagccagagaaatgctgcaagggtggtgaagatgagaaataacaggcagttcacctggggaaggaatctcccgaccgtatctttccatgataatccgaacggaaaaggtccggggatatactggaatacaccgtactcatcaattctgacacctgcacgatgagcagcatacatgacagaagagatgatgagagtaaagacaaaaagggccaggaggtactggatcaaaatggtatagaacggaagcgagaagatgtagaaactgatatccaggccaaacaccgggtcggatatatggaaaggtgtctgatcaagaaatgccagaataatctcccatgatgatgagagggagagaccggtaataccggctgcaacagcacaagcaattcctccaagatactggatctctttttccactccgaatgcccctgctccggtgcgggcggccaggatgacatttccataactgaacgcgaaaaagagcagtgttccgatcacaaagagggctgccgatgtgatcaggatggtcaggaagacaggggagtatccaactgacgcataccagaagagatcggagagcagatcggtgagcagaaaaaagagcaggatgactgctgccgggatgaatatcagaagttttcgaagtcgcatagtgacgtatgcatcttccctttgagatgaaataaggtttttggaaaaaccccggaagaaatatttaaactcatacggtcatcatgtattcaatcaggaatgaataccatgaaagagagagacatgcattcccatagaaaaacgatgatgcgaatcatcgcgattcttacttgtatctgtcttttgagtgcaatcgggtacgggtcttcggttgaccgctcctcttggaaaaataaagggactgaacttttattggtgaatcaaaaaatttcctctttagattcatttggcaaagcatttatggcgtacaactattactgcaccacaatgacaaaccagaatgctcccctgaactcaaacctggaaacccgggcaacatacgggactgattatacctgtgaattccacaccgaaaacctcatgggattatttgaaggacttggaattccaagcaccgatatctattatattgctgcagatgatgcggactgtctggctaccatgatgaattgtaaccacatcgctgcaatgattcagtataatggcaactggtatgtctttgatccatgggaagcagcatttaccaacaatggatcatacaccgggggaaccaccctggaatggaatgcaatgacgagtggtgagtggaataacaggatggtagagcagggatatgacagattctctctggatggtggtgatagctggtcgcccacggtatttgatgctataactgattatcaggagacatttgaaggaaaaaggactcctatacctacacagatcatctatgatacgtcccagattgtgtatccacccggattataatctctttttcccacaggtgattgcgagtcccgtttcgtcatcgaatgaatcctgtggatttggtatgatcatctcttatgcatacattaagaagggagtggggatgattattacagatgaatatatacaccacatcatttcatccggaaagccctgatgaaccggttccatggtatgaaatcgttgagaacgagatttatacaaccctgtaccatccgactcatccccaggaaccagtctcatggtatataatacggaaccaggaaatttttacatcccctgatcacccgacacatccggatgaaccatttccatggtttgaaatcaataagaatcttatttacccttcagaaaatcatccgactcatgcagataatgatctgccctggtttgaaatacgggagatataaaaaaaggggagtgaggtctgcgacggaccttttccctatggtacaagagaggataattcaggcggtatatcaccaataccttcagcaggctggataggatcctgacctaatccctgtaacacgtcttttcctttttcgctcagcatgagcctgataaaatcaattccggcacccctgttttgagcattgaccgggatggaaactgtaaagacaatgggtggagagtgtttcattcctgaaccggtgtcaactccaacactccagtattcctcctgaaaatcaggaaccgacaggtcgatctcttttggaaggtgaatcatatgtaaaccatgctgaaatgcacccccctgttaattccaggcataatctaccgtgccattctttgtatattcgatgagctcggttgttgtattcagaaccctgaaattaccatgactgtggggagtgactgctgacagcacggttccattctctgattctaaacgggttatatcagactctgatggaataatagtactgaagactggtttttcataataatcatctgcaaggctcatagtcaccagcgaacgccaacccctggcatctgcatcagggtgcacaatggcagttgttacatttttttggcttaaaatatcataccagttgtcagacgttatcatttcagcacaggcactgtccgaggtgtatgaaagcaccatagcacaattgccatacctgatatcccatgtgatttgagatggcatcagccctttttcaaaggacacataatctggaacaatgagaacatcataaccggattcactgttcttaaccatggaaaccagctcaccggtcccgttagttttcaccggatgaacctggatatccgggtagttttcttcgaagagtgcaataattccttccatttgagaatcgatggaaaccggatatataacctgaagttcattactggctgaatctgcagtaccaaaacatcccaggagagacaataacataagtatccaaatgaacattgaccacttgaagatcatatcatccctgatattatctggaaattctaataactatcggtaatagtgaaaaaaaaggaaaaaattaatatccgcgaatttctgccctgactttttcaaggttttcaatccgcttctcaagagccgggtgagttgagaagagccctgcaagagtttttccagacagagcggggatgatgtaaaatgcatttgctccttctgcctgaacttttgcctgtgttggcagacgttccatcttaccgctgatcttctgaagagctgagatcagggcatcgggattattggtaatatatgcggctccccggtcggctgcaaattcccggtacctggagagtgccatcatcaaaagcgttgcaataacccataccactgctgcaacaatacctgcaatgatccatgctcctccctgttcccggttactgaatattgatgcgaacaggaaattgttcatgatcatggatgcaatcatggcaacaaagctggcaaccgtcatggtcaggatatcacggttttttacatgagagagttcatgtgccaggaccgcctcaagttcatcgcggtttaaggtctgcatgatggaatccgtcactgccaccacggcatgattcgggcttctgccggttgcaaatgcatttggcatcggggagtgcatgacagctatccgtggctttggaagatctgcttcctggcataacttctcaatagtgcggtgaaggtccggtgcttcatcatattcaacaatctttgaaccggtggtcatgagcaccagcttgtcggagaagaaatactgaacaagacccatgacgactgcaatcaggataataaatccggacggaagtcccagggccatcaggatacccatgaacacaagatacacgagtaagagcagtgcccaggtcaggaaaattcgtcctgtcaggcctgcatcacgtttccacttcatatcggtctaaggtacttttatctttgaggataaagagttataccatccaaaaggggattcctgccggaacacaagaagaaaggatttattcagggatcaattatcgcccgatgcactgcttcatcagggttttcgcagggtatcactccgggaatatcccaggttgaaattccatataccgggatccctgatttgagagcaaaagcaatctccgatagtgtcccatattctccaccaatggcgataaccgcatcagctgatccaacaaggatgacattgcgagcatgatccatccgggtttttactattgccgatagataggaattgccttctgaaccgggaacaatcccgaccaccatgcctcctgcattggaagcaccacgacatgaggcctccataactccaccccttcctccggaaagaagaacaattcctttgtgtgcaagaagcacaccgacccgttctgcatggatcaggtcctgctctcctgcatgggatcctccgattacagcgacctgttttccagtatttcttgtcccgtcacccatatacacccacgactccttcaaatggtaagagatttatcctctatccggctgatccgaacgttataattcgtttatgcactacccgaaaaatttacccatgaaccttctttttccggatatcggaatactatactataaccggtgatgcaatcgcatctgcatagatcccgtttggaatactgatatcaaacctggcacctttcccttctgttcccgtctcggtaattgatatcccggttaaagcaaggatctccctgacaagaaagagtccaagacctgtgtgtttcccatgtccacgttcaaatattgcctctttctcatcatccctgacaccggtcccgttatcctcccacgaaatagtgtacccgtcaggatgcctggttccagaaaccagaatatgagatattgttcccccatgacgaagggaattatcaaggaggttgaaaaagactttttccagcatcggatcagcaaaaacagaaatatcttccagagtaacatccaatgtcaggccctcgggaatctgcagcccctttatgatcatggccggggattgccaggcaggttcatggattcccagatcctggtagagacgggtaaattcaatctgcttttgtattgcagttgtggcagcttcaagggttttgaagtaatgggaaattgtgggatcactgcattccatctctgcaatctcaattgcacccagtatgatggtaaccttgttcagaatatcatgcctggtgatgctgttcatgagatttatctgccgtgatgccttccgcagggatttttctatctgtttccggtcagtaacatcacgaagtgagagaaggattgcaggcttatcctcatattgaatcagttttccaatactctctaccgtgacaggccggccatgagacgtaaccgcttcatattcggcaatataggaatcatgcccctgtgcaacttcagaaaaatcacgaatgaccgcttcatgtgattcaggagagataaattccatgacattccggccgagattgccagggatatctgccacttcaatcatctgtgcagcagcattattcgcaaagagaagccttccgtacagatcaacaatgagtatgggctctaaggcatgggtcaccaggaaccggtatttctcctcactctcaaaaaggtctttttttgttttgtaccgttcgacgaccttatcaatggtataggccaggtcagaaaaaaccgttattggatcattccctttcctgacgtaataatccgctttctgctcaatggcatggatcacaacctcctcatcaccctttccggtgaagagaataaaagggatatccccatggttctttctgacttcggtaaggagagagataccatccattcccggcatcatgtaatcggaaacgatgacatcatatcgggtctgtgaaagagaatccaatgcttcttttgctgaagaacaggttgttacagaaaaccccttccgggtcagaaaaagagatgaggcaatacagagatcctcttcgtcatctacatataataccgaaaccaaaagactccccccaccgtatccacttttatccgacctggtgaacccttcatccccctgtatcgtgttcacatgcccggatttaattataaattatccatcttttttccttcataatatatatgcatatgcctcccgaccaaggagaggagacttggacacataatattcgaaaattttttcggatacatcaggattctgatctcacatttccctccatgcagggcaaatacttattgctctcgtgttcctcataatggaggaagatatcatgatcaagaagattttatcaaccgataaagaatcatttgaatgtaaaattctcaatccgattgagtactggctttggaaattccggtatgtatcatttcttgcagtcatattttgtgccattgcgtcagtggccctgtttgtcatgggcactctggagatcatccacccggttaaggaaatattgctgagtattgcgggtgttgcaacagaacatgcaagtcttgaaaatgaagagatactgaaaggctttatcggtgcacttgatctgtacctgattgcagtattcttcctaatcttcagtttcggtttatacgagctgattatttcgaagatagatgttgcacgtgatgcatgcgatgacgtcgagcacccgcttcttcagattacgtcactggatgaactgaaaagtaaaatcatcaaagttatcatcatcatcctgatggttgcattcttcaagaatgtcatatcaatgaagatgattgcagtcagtgatgccctgctccttgcactcgcgatacttgccctctgtatcgggtcatacttcctgacaaaagaacattaaaacgggtggaaaaaccctcacatcttttttggatcgtacgaattatcagagcatttcaccagtatgactggagatctatcttcgtttagagaacttctgattcgaaaaaaagagttatttaaagggataagaaaaatgggtattaatagttatcgcaccagagttcaaagtgtgcctgtgcatgtgcacaaaccgggcagggatttggtgcttctgatccttcatggacatacccacagtttctgcatttccacctggtgggagtgttccgcttaaacacggttccctgctcaaccgctgcaaggagtttgcggaaccgttgctcatgagatacttccactttcgcgatgtgacggaatgtctctgcaatttccttaaagccttccttttctgcagtttctgcaaatccgggatagagggccccccactcatggctctcaccatctgctgcggccttaaggttctccggggttgtttttatcattcctgacggataggatgcagttatttctgcatctccaccaggcagaagtttaaagaagagctttgcatgttccttctcattatctgcagtttcggtgaagattgcagatatctgttcatatccttccttcttagcaacacttgcaaagtagttgtatcgcatccgggcctgggattcccctgcaaatgctgcaaggagattcttttcggtctggcttccttttaactccatattgatcagcctctaccataacatgatctgttatgtcgtacagataataatctgctctgggtcaataaatagatgacagataacgatatacaatagaggttatatgatagccgatcctttcgtctttataatcgcccctttttttatcgtcctctccatactggtgatcgtcctatttttcgttgttttctatatgttaaaaaaccttgataaatcgggtggatatagcatactggttgagcaatggccagcaagtcaggaacctacgggcacgctgttttcacgtcagacccttgggctgggaaaggtctggtataagaactgtgtgaagatcgtgatctccagggaaggactcttcatctcattagggtttcctttcagacttttatccctcattcattcagagagtggaaagagtgccctcatcccctggggatcattacggtaccgacaaaaaagcagtgcattctggacacatgtgtatgaatatgaggttcaaagtgaaaaaccagttattcttaccgtttcaaaacagattgctcactcatttcctgaatatgtaaaaccgccaacatgagtagtgatgaacgttcagctttttttcagaactattttttcaaaacgctttttcagggcaggatctgtgcagcattcctcaataaattcgactactcccaggagcttaccatacgattccggtgataatccatgttccatgatacaggcatcatggtctgcaacggttccatctgcccctattagttcaagaagcgtgcgaagtatggtgtgagattgtatggttctctctgcaatacaccgcccttcatcagtcagggtcactcccccgtatggctcgtaattcaccagtcctgcatcctgtaaccgcttgaatccgtcggtaacggtggcaggggtgatatgtaatgcctgggcgatgtcccgtgattttgcatatcctttctcttcggagatttcaaagatcacttccaggagatcctcgttccgtctcgttactttctcttcagccatgtcagatattatatgtaaaaatgctctgatactactcagtcacgtttgactcggtaaactatgtgttctaatctaccatataataataagaatcagagcacaatcgcatttaagtttaatggagaaagcaacactattatgagaagaggtatgcgataagaaagagcaataagaccggttacaatggtacgacataaaagcacggtattaccggtcaggctgatgctcatatgcaaaggcgattttttcgaggaatcttatcatgttggaccttgttattctgcaacctccagacagatccggacataccggttgtctgatcaatacttccttttttggttgatatgagaggttcccaaaccttttttcagaaaagcatactgggtataaaacctctcgttcaaggggagaggatctcagaaattcgcagaagaaacacacaatatgaaaagtgtatcactatcggctaccaaatctttcataaaaatcccccttttttgggcaaccaggtatctttacaaagtcacccccttaaaaccttcaatttgacccctattatcaaaaatacggccatttgatatatcagactacctgcgacttaaggttgcaccagataagcgaattaaatcgattattttgctgaataaaggctgaatcgcagagttatagaagcacgctatcatacatgaaatctacccatgagttagtatacctgaaggtgagatcctgcaatagagggcggatatatgaatgttatttttgagaatataaatatatataatttaatacaatggcgtcgtatggatgaaaaacggtgattgcatatttttctctttaaggtttatcaaacgtaatcgttcttcccatgtgatcggttattacaatcggggattcaaaagacagaattatcataatttcagcacagattagaagaaatcccaaaattgaataaaacagaattttgttgccataatgaaatgattctccattgtttgattgctctctgtcaggtgctgattgtaaaaaaaggatttagcaatagtatgattttaaaagttttattcaaactatcattttctatacccgatttggtcaataataaagtaagccaaaattgaggacgttttttcaataaaagctaaatcattgctgaaaccagatagccaattttctcaatcacaggtcccagcctatccttccatgccaagaattgcagagaggtgttccatccttacattcacgatttttgtgctaagacaaaaaaaccgagattatatattctgaaaatatcatagtatatttgcaaccgttgtgagatgactaattgatgaaaatactagataaaaaaacatgttctcatgttacacgtatcagaccatcattatgcattcttttgatccttttcctcactgtctgcatggttagctcagctgacacaaacagcggagatactggcagtgtaacgataacagatgactggggaagagaagttatccttgaccatcccgctgaacgaattgtctttggccataccgctgcaggtgaaggaattcttctcgctggtggctgggataaagtagtcggaagggacgcttcaatcacgaactacaaattttatccaaatcttgattcacttccggtaataaacgggctgaatcaggcatttaccctggatttcgaaaaaattactgagttagagccggacctcgtaattctccaaaagaaatactcagaccgggaaaactttgatgtaattgctgaaacactggcaccggacattccggttgtgggtcttgatttccttgatccggaatctgctgatagtattcaaaagttaggcgttctccttggaacaagtgatgttgctgatgaatatgtcagatttcatgatgataccatcacaagcattcgggaaaaaacaagttcacttccagatactgaaaagccacatgtatttatcgatgcagtcggaatgggtccagaacagatttcaacctacggaaaagaggcttcgttctggaataagatatgtgacattgctggagcaaagaacgtagcacaggatttaccttcggattttgtaaaaacagtagatctggaatggctgcttgaacaggatattgacagtattgttgttcaggtgtgggacaaagaaaagccggaatatgttggctataccgcaacacagcccgcaaaggcaactgaggaagcagaggttattattcaggaaatttcagaaaaagatatatattcacataccgacgcagttcagaacggacaagtatttgtccaggactatcaactagcaaataacccgaaatctttcattggagttgtgtacctggccaaatggatccatccggacctgtttgcagacattaatcctgagcagattcaccaggaatacctgaagaagtttattggaacagaccttgatttgaataatgccgggatatttgggtatccctgaataatttttgagaaatatgaatgaatttcctgtaatgaatgagtccctgaatcggatatatgaacaatccctctcgatgatttcagcaaatgctcttgccgcaggagtgaaactctgtgttttcgataacttaagggaacccgttaccgtagaatcactggcaaagaaacagggattaaatcccggagcgacacaggttctcctggatactcttacatcttgtggacatcttcataaaaaagatggaatgtacaggaatatgccagatactgacagttttttggtatcaagtagccccacgtattatggagagatcctgcttcgcgaataccagagaaattcaataagtcctgatgtcatcatagagcgggtcaaatccggaccggttccccagtcacacacaaatgatatgtgtaacgaagggttttgggagagatatgcccgttccatggcaaattgggaacgagccggaacagcccagatgctggcatccgaaatatccggcctccctgaatttcaatcattcaaaaccatgctggaccttggcggggggccaggtctgatgagtatagcgattctcaaaaaccaccctacgatgaccggggttgtatttgatcagccttccgttatcccggttacgcggcagtttatcgcagaatatggcatggataatcgtatgagcactcagggaggaaattatctcgaagaatcatttggatccgggtatgatcttatcctctgcagttgtacgcttaattttgcaaaatactgcatggatactatggtagagcggatttatgatgcccttaatccggggggaatttttgtgagtttgcatgatgggatgaatgaggaaggaacatatccacgagttcatgtcctgaacatgatgaccagtgcgttatccgggttctcctgcagtcttgaaaaagggtttattgcagatgcaatgaaaaatgcggggttttccagtgtcacctctaagcaggtcataatggatgtgggaccatttgaattggatatagcccggaaagacacataggagtgaatcttacatagtggtttttttgagtgtgaatagaagataaacttttttggatataactaaagaattttagataaagtaaaatagaattatcttcaaataagtattcatgaaacggttattacctaaaccattcattaaagattcactggaatacaagagtaaaaaatcaaatggcttttttataattacttatttccttatgattattgccatcgcatcctctccggtgagttctgcagacatagaaaaaacagcgggagattccagtatcactattatcgacgactggggtagagaagtgacccttgataaacatgctgaacgaatcgcattcagccatacagcagccggtgaaggaattctcctggcgggtggatgggataaagttgtcggtagagatggctctcttacagattccaggttttattcaaatctagacactattcctgctgtgagcactcctaatcaggcattttctcttgattttgaaaaaattacggaacttcatcctgatcttttcatcatccagaaacactatgattcaagggagcagtttgatgaaattgccaataaacttgaacctgataccccgatagtcggcctggattttcttgaacctgaaaatgctgacagtatcaaaaaactgagcattttaatcggaacagagcaagtcgctgatgattatgttaattttcatgatgagatcattaaaaacctgaaagaaaaaacagatacattatcaccagacgaaaagccaaatgtttttttaaaaggtggaactactgataaaattagcacatttggaagagatgcttcattctggaatagaatgtgttctcttgcaggtggaaaaaatatcgctgacggtcttcccggtgataatcaagaggtagatcttgagtggcttacccagcaggacattgacactattgttggctcatgcagttatagaaattacccggaatcttttggttatctggcaaccgaaccattccatgcatctgaaaaagctgacgagataatcattgatattaagaataacgagattttttcacattcagatgcagttttagatgataatgtcttcttactggaaggaacgatgataagcaatccaaaagcattcattggatctgcttatctggcaaaatggctccatccagacctcttcagcgatctcgatccagaacaaatccaccaggaatatttgagcagattcattggaactgattatgatcttaagaatattggattattcggatacccggctaattcataaaacctacaaaaatggctgctgattctaacattaactggaatgagatctggaaaaacacatttgagaatcacatgatctcccgtggtcagggggaatatgctctcatgtgggatacaaaggaaaaagccgaaaaatatctccagatgatgaatcaaaaccctgaaaggactgaaaagattatctcgcaactttctttctctcccgaattcaggattcttgatattggggcaggtcctggcactctgtcaattcccatctctggaaaagtgcatcatgttaccgctgtagaaccagccatcgggatggcagaactgctaagggaacgaacgaaaacagaaacgaaaggaaatatcgatattgttcagaaaagatgggaagatatcgatatacaaaaggacctgactcccccctatgatatggtcattgcttcgtattctctggttatgctggacctgaaacaggccattgaaaccatgcaaaaagtatgctccggcgagatatggctgttctggatggctgggatgaacagctgggaagaccatatgaaaaaactctggccggttattcatgggagatcctttacctcaccaccgaaagccgatatcctgtttcaggttctgtaccagatgaatatctatccaaatatgtcggtcatggaaatggaacatgtaaagacatatcctaccattgaggaggcagttctggagacgagaaaacaactgaactgctccgcagattatgatgatcagattcgggaactagtactcccaggcctgatttaccagaatgggacatacatcaatcaggaacggtacaagagcgtttgtttttcatggaaaaatgaaacatgaactaatttttttatcaggatgaattttgaaattttgagatctccatgacagcagaatctacccacacacagaaccagccggaatccatatatgacatgtatgcacagtttatccgaaggaaattactctttattcttcttttgattggtattatcatcattcttgttggcattgccgcttcaaccggatcagcaaatctgtctttatatgaagtgtatgctgctcttgtcggaagatttttctcatgtggtccggagagttcctgggttgctgatgtatgcctctggaaacttcggtttccacggatattcatggcaattttcgcaggtattgccctcggtgccaccggagtcgttatgcagagcgttctgaagaaccccctggcagatccctacatgatgggtattcagtctgctgcaggatttggtgcatcccttgcgattatatgtggagcagggatattcggaggatcatatttgattgccgggaatgcctttttattctcactcatctcggttggaatcattattacactggctgatatgaaaggagcgtctgctgaaacgatgcttttaaccggaatcgcagtcatgtttcttttttctgccatgacgacctttattcagtattttgccgaggcagaagcggtaaaaagtgcaatgttctgggctgttggagatcttgggaagaccagttgggatgatttttatgtggtcatcccccttgtagccatctgttttctttacctgctctggaaaacctgggacatgaatatccttgcatctggtgatgaaaccgcgaaaagtcttggaattccggtcagaagggtcagaatatcggtgatgattgtctcatctctgctggtttcaggagttgtctgttttatcggggccataggatttgtcggtcttgtatcgccccatatctgccggattattatcggagggaataaccagtacctgcttcctgcagccggacttatgggagcaattcttcttattgtatctgatacgattgcccggaccgtgatgagtcctgcaattattccagtgggtgtggttacggcatttcttggtgttcccttctttatctacctgatcatgttcagaaagggggaattctggtgactctttcatttcatgggatatccctatcctatgggacaaatcaggttcttcatgacctctcatttgaatttcaggatgccgagattgttgccattgtcggaccgaatggttcagggaaaagttcccttgtccggtgcctgaataaactggtaactccccagtcgggagaggttattgtcgggggagaaaaggtgtatgggatgcatgctcgggaagttgcgaaaattttcggatatgttccacagaattttcaggataccttcccggcaacggttatcgataccatcctgatgggaagaaaaccctatgcaacctggagatccggcaaaagtgatatcctgaaagtaaccgaagtgatgaaactgctacaccttgaacagtttgcactccggtatcattcagaactctccggcggacagaggcagaaagtgatgattgcccgggcatttgcacaggagagtaaagttctgctcttcgatgaaccgacgtcacaactggacataaaacatcagcttgagataatggatctggtcaaagagaccgtccggatgaaaaagattcttgcgattcttgtggtccatgacctgaaccttgcatcccggtatgctgatcgaataattatgctaaaggacgggagaattcatgcagttggggatccaaagaacgtgctaaccgaagataatatccgggctgtctatgatgttgatagtctgatcatgcatgacggggaggtgccatgtgttgttccgaaaaaaaggttacatgcgggatagttcttcaagtttgcttgaacagactcttgtttcaagcccgaataagatgatttttctgttcctttttcctttcagttttccagctgacaatactcatcgtaattaaggggttccagatataaaacccatcaagggatatgaggttttggaaaacccattgtttaatgaattcatgttttccaggataggaatgaccgcatctttgctctatctcaataaccgctttatcaattgattcaaacttttcataaaatggttgacggatatgaataatatcagggtaaattccgatttcatttaagaccaaaacaagaaggttcgtttttggactttcatggtaatgcataccacaggcaccggtacaaatgcttttcatcatctgatcccaggaatttacaccagaaaaccagatcaagtaaattgttcctgctgatactgccatcatttttttaagactgctccgaatatcaggcattcccaaagaaaaacaagcaataatatgatcatatgatcccaattgttcaggtaacacatcctcccaccgggaatggatgattttaatatttgaaaatccctgatctgcaatgttatcagaaagaactgatactattccgacagcaggttcaacaaccgtaacatgagcacctttttgtgctaaagggagggcaatagttcctggaccgccaccaatgtcaagaaccgcctctccttctctgatagggattctggataatatcggagtataaaatgatttttgttcctgagtttttttccaaaatatgaatgcttgttccttagatgaccaaaaatctgatagatttctatttgcctggcattgccaattcaggttgaattctgatttccagaccccagaccagttaattttacttaaatccatcgctgtcataattttaggatgttccttattgtgaagccaggatgcttttacgaattatttgtattagatcaatatatattgtattggggagaaccaactagagttagactattcatacgaggatacgtcttactcctggagattatatgaaacaattatggcgagtaacgctttggtgtatcctgatagcatgtatctgcctttgttcagcagagggatccgtaacggtaactgatgatcttgggcgtgaggtcacattggaaaaaccagcagaaaaaatagctttcgagcattatgcacccgctgaagcaatcaagatcgtaggtgcctgggataaactagtagcccgtgacgggtatactactgatccagaatttttcccagacctggataaaattccagcaatcagcccagtaaaaccaaccgggaagttggatcttgattatgaaaaaatctatgaattaaaaccggatcttatgattatccagaaacaggactggaataattatcaatacaatgacctttttaaaaagttagaaccagagatacctgtagtgattttggatttcatagatccactcacccaggcagaaagcattgaaaaactcggaaaactaacaggcacagaaactagtgctcaagcatatgcaagttttgtcaggggtataacctccgatattaatgctaaaacatcaatcctttctgatgaggaaaaaccggatgtcttttttaaaggtcctgcttacaagccagagcagatatttacctacggaaatggcatgaaattatgggcaaacatgctgaatctcgcaggtggaaggaatgccgtggataatcaaagtgctgcatggtttgaagtggattcagaatggctcattaaaaaacctattgatatcatggtagtgcataatcgtgaagccatgtatccagatgtgttcggatataatgcgaaggatcaggatgcagccaaagaaaaggccaattctcttattacaaacctaacttcaaacccggttttctccggtaatgacgcggttaaaaaccaaaagatatacctgattgctgatccactgaccggaacacccagatcaattatcggcgttgcatacctggcaaagtggttccacccggatctcttcaatgatttaaatccggaagagatacaccagaaatatctggatttcatcggtgccaattatgatttgaaaaatacaggtttatttggatatccaggtgaatcatcataaaacagataatcaactcactttttttcatgtagcagttcctcgaatcaaatccccataatccggagtagttacagtacctgtaccataagaaaaaatggtggattcgcctgtgaatgaagcaatgaacctagcaatatctagtttcatacagatttctatcgttcctgatttgatgcatgaaattgacactcgtaaattcaggataacaatccttatgtaaaactatctcatgaacattacaaggataatatttgagatccattgatacgagagaaataatgaggcaggagatgaccatcagaccagacatattttcagaaataaagcagtatatcgacatcttccacatcgaaccggttcgcaaggggtactctgaagatatgaaatatctcctcacggcaaaatccggagaaagattcctgcttcggataacagaatctgacaatactcaaatcctcgccggaaggaaggagatgtattcattgatggatacactcgccaaatattcatcactggttccccggtcacgggcatgttggatctctcataacgcttattcctgcatcatgatccatgagtatattgaaggtgatgatggagaagaatcattgcaccggtatagtcaggaaacccagtatgaaataggatatcgtgccggaatagaactgaaaaaactccaccagcttgctgctccagccactctttcctcatggtataccagaaaaaaacaaaagcacgaacgatactgcgatgcatgtaaccgggagcatctggcaccggaagaactagatttagaaccgattcatagatatattgctgataacatccatctgatgaagaatgtcagccagacatttcagcatgatgattaccatcctgcaaacctgatcatcaataatggacaactgacgggtattatcgattttaaccggtatgattggggagatcccatacacgatttttacaaactggcatttttttcccgtgaaatcagcatccctttctcacggggtcagattgatggttattttatgggaaatgtcccttctgatttctggaaaagatatgccctgtataatgcaatgagcattgtcccttcaattgtctggttctcgcgaatggcatcccgaaaagaattcagggatgaactaaaaagagcaattactcttatacgaaccctgatagatgaccataaagggtttacttcagcgattccgcagtggtaccagtaggataccactcctgaaaaatgatggaaagtcatcctctccgttactggtgaggtgatcccggacttgaaaatgccaggagcctgactccggtaacctgctgaaatgtcgcaccctgtccgatggcattgagcacagcattctcgtcaataattttggatccggcaatgatgtttgctccatgatcaaagagaaccggagatatgggcgtacttggaccaagaatgaccacaagtgcttccggtttacatagcccaagcagatcatcaagagtgtgattgatcagagaacttccggtaattgccacaacatctgcctggggaattaaatcagaagctgcatgggccggatgatctccttctaacgggttttgttctatcacccagagattctttactgccttttttacctttggaatgaatgggaaatgaccaacgattgccacattttttcctgcaccccgctccatcagaacttcagacgcattcatctccacggcatcattttcattatactccatcagtgaattaatcgcagctattccaattcctgcttctatggtattttcagatagggcatactgtgccagttcctgagcactcttctggtgaagagtccctacattccggacatgagtggtgtgatcatggggtttatccggagcaaaggttgtcgcgagaccgcaatgactgctgcacacagcggtccaatgaacaccaaccatcaccgaacggacagtaacatctttttttggcagattagacagtaattcttcaataatgtgagtactcataataacctcaatatgaataataagaaacccgaaatatcgaacattgaaagttgaagcccgaattttctgatttcaggaataataagatctgatgtgcagacataaagcaattactcaaaaccaggtaataattaatatatattacaccgcgttgaaatttctcactcccctttagtacaattattttagtcatttcgggttttttcggtgtgtcaaaactgttttggaaagatttattatgaccgaatagaaatacatagttttagttagaattaaaccgttaaaataaaaccataagaaatcctggattcaaggaatccgaaacgaaaacttgtgtatttcatggttttctgacttatgactggccgataaaacaaaatggattgaacatatgatggaaaagagaacatcaccaagaaatgaagatcttctggaagaaatttataagatctcactggagaaggggtatgccaaatcccgcgacattgcaggtgcactcattatctccccggcaaccgtgactgaacggtttaaaaaattagaggaagcaggctatgtaaattatgaaaggtacggcggagtgaccctgacacccgaaggaatacgtattgccgaacggacgattcagtcccactatgcaatccgaagacttcttgaactggccggagttgaaacaacaatcgccaaccgggatgcatgcatcatggagcatggcctttcacctgattcgtataaaaaactggtcccatttattaaattcattgaggaaagatgcaaaggtatggagatgaaaaagcaattatcctgatctttttcttagtacaataatccccacccttcagtatctgctcgctgtctggtattctaacattctgacagaactcaaaaactctttgattcagatttcgggaaactccggtttttcgaaaaaagttgggccatcatctaaatatgccatcgttgcgtaattgtaatagtttaaaataaaccgttgagaagtaagtatgaacacattaacatcccaaatgaaatcagatccggaccattcggatctcgctgatgaaaagataaacccagaaacatacagtatcggtattgatatcggatactcatcgatcaaaatcggcctggtgaacagttctttgcaaccagtatatgcagattacatccttcataaaggaaaaatcaaagaaaccctgcagaaaatacttgcaacgcttgcagggcagtatgatccaacatcaataacacatggggcggtaaccggaagtgaatcaaaatggatatccaaagatcagaccattcatcacgtcaatgatgtatcggcactccttgaagggagcctgtgcctggatgattcggttcattcaatcattgatatcgggggacagaccgccaggtatattaccggatttacgagcagggaaaaatcatgcatcgaaatttctatgaactccaattgtgctgcagggacgggttcatttcttgaagaacaggtgtcacggctgaatctgtctattgaggattatgcagcctatgcggctaaaagttcaagcattccacgaattgccgggagatgcagtgtatttgccaaaaccgacatcatccatcatcagcaggaaggtgttccagttgaggatattctccagggtcttgcatatgctcttatcaggaattaccggggagcagtaatcaaaaaactgcccattacaagaccagtattcttcgctggcggagtagcacacaatgacgctattgtcaatgccatatcagacatcctagatctctctgatggaaaactcatcgtttcagatttgagtggaaatgctgcagcaataggaacggcaattattgctaagcagaataatctgacaatctcacctgatgaattatcctcgattctcacccgcaacgaatgcaattcaaacaattcggaactcagcctgccagctcttgcccggttcggaaaggaagactgcacaaacaaacatatctgtgctccaatctcttcaggagatgagataaccgattgttttctaggcattgatatcggttcaaccagtacaaacctggttctcatgaatgaaaacaaggagattgttgcattcaggtatctaagaactctgggagacccattccatgcagtcagtaccgggcttgctgaccttggaagagaattcaaagacaaggtacgggttatcggagttggaacaaccggttcaggacggtacatgattgcaaggctgttcggagctgatgttgtgaaagatgagatcaccgcccaggcaagagctgcaatcacgcttgatcccctggtagataccgtgtttgaaatcggcggtcaggactccaagtttatcagcctgagaaatggtgtcgtcactgactttcagatgaataagatatgtgctgcaggtaccggatcatttatcgaagagcagtccaaaaaattcgatattcccattgatgattttggagataaggcacttgccagtacaaaaccggagtatcttggtgaacggtgcaccgtattcatcgaaaccagtattgccgcctgccttgccaatggaactagtactgaagatatcgtatcaggcctgtgctattccattgtgaaaaattatctgaaccgggtggtcggacagaagaagatcggagatcggatattcctgcagggaggtatcgcctataaccagggagtgatcaacgcattccgttcactgaccgggaaagagatcattgttcctccattctttagtgtgaccggagcctatggagcggcaatcctgacctgcgaagagatgggatcacggaagacctcattcaaaggatttgaccatatcgcctcatccggtgagggagagatagaaaaagtagcgaattccgattcaggatctgattttgaagagatggtcacggaccttatctttgaagggtatgatggaacactggatcccagtaaaaagaccatcggaatcccacgggctctcttcacctatggcatgtatccaatgtttgacgcctttttccgagagctggggtataatgtcctcctgtcagatccgacaagtgaaaagaccatctggctcggacaggattattcacttgacgagacctgttacccggtcaaactgatcaatggtcatgtggcagagctggtggagaaaaaggtggactacatctttttcccagacctgtacacggttgttcacccaaactcccatacccgccaggattttggctgcccgtacatgcaacttgcattcaaactggtaaaccgggcaatggaacttgatacgaaaggcatcaaactgcttgctcctaccatcggttttagtcttggtgaacaattcatgaaaaacagttttatgaatcttggaacgatgcttgaccggacaacggaggaaacagggaaagcccttcagaaagggatgcaggcattccatgattttgaaacccggattatggaaaaggggaaacaaatcgtgcagggccttcaggctgatgaaaaggcatttgtcctgatttcaaaaacctacggggtagcagatcctgtcttaaaccttggtatccccggaaaactgaaagagatgggatataaaacccttgcattctataacctcccggaatgtgatgtttcgagcgaacacccaaacatgttctggccatttggtcagcatatcctcgaagcggcgcaggttgtcaggcaacatccaaacctgtatgcaatcttcctgacccatcatggatgtggtccggataccgtattcacccactatttcaaggagattatgggagataaaccatatctgaacatagaagttgatgaacattcttcaggagtcggtgtgataaccagacttgaagcattcgtaaacagtctgaaccatataccctcacagcctgcagaggatatgaattgttacccggaacgtgttcctcacccgaaagccgggataacaaccaacggtcttgcattttccagttcctgtgagtattacctgcctgatctctatccatattccggacttttttgcgaacatttcagtaaaaaaggaatccgtgctcacccgtttccacctacgagtgaaaagtccattgatgaagggagaaaacacaccataacaaatgaatacttctcaatggctgcacttgtcggtgatgtactgaatattccggacattcgaaacaaaggagatatcccaaaagttctcttcattccacagaacgagggagcagaagttgacgggcagtataacaggtttatacgcacgattcttgatgaagaagggctatctcacgtctgggttgaatctccgttcattgaagatatcatatacgaggatgagagttttctcacatcactcttctgtctcctcattgcaggagacttaattctggtgacccccgtgtctgaccgggccaggtacctgaaccagatgaaaggtatgatacagagaaatgaacttgatatccgttctctgaaaagagtcgcctgggagatttcaatgatcctgcagtcagcacctccggaaaaaaccatccttgccataggtgagccactcattctctacaatgatatgctgaataaccagatcctgaatggattagaagagaacaacgtccgggttatgtttgcacctttgagcgaatgcttctggcagacctggaaggattacattctccagtacgggaacgacaggactgatgtcctcttaaagaaacttgccatactcgaagattatatgaatcaaatccatcaggtacttggtgtattcagcccatatgaagagaaaacagaagaccttatcagactcgcagatgccaccaccgggtactatgccggtggatttggaagatacagggaggcaaaagttcttgggttaccgtcatcggtcaaaggcgtgataaccgtttcatcaatgtatgaaaacaccggaatcctgcttaatactcttcataaaggatttgaatcagaccaccagaagccggtgctaaacctgacatttgacggaacacacaatgaccatgacaaaagcaaggttgaatcatttctctactatctgtaaattcctagaaaagaggtaaaccatgaacacatctaccagtgatacgaaaaataatgaatcgcacggacatccatcaaacgaaccgggttcaaaaaccggttctgatcatattatcatcccctgttgtggtcaggcaaacaccggacagatatccaatgaggttgcaatggtcctgtcagatgaaggattcgggatgtattactgtactgctcttcttgcaacgaaaccagaggttattataagccgaatgcagggaacggagaagatcatcgccatcgatggatgcactatagcctgtgcaaagaaaattgcattgcaggcaggatttaaggtgaaccaccatgttctggttactgaccttgggattgaaaagaaaaaagggcgtaactttacttctgaacaggttgcatgcgtcattgatgttatccggaagggatgctgaccttcaggacatgacaattccctcctcttgcaatccagatattatatgatttcacctgcagcattcagttattctttcgttggaatgcatatactccgagagttacaattattgacacatgtacaacagacaggatctatagttaaatattaaccgtaataaaaacaaccgttagacataatgaaaggaaaacccaacatgtgtttatcatgaaaaatatctggaaatttgctcctgaggatggaaaagagagagggctactcacccttctcgtccttcatttcctggagaaaaaaccacaatctggatatgaactgctaaaggagatcgatgagacaaccgatagtacctgggtgccaaataaagggactttgtatcctcttctgaaatcattggagcaggagggcttgatacaagtgaaagaggtaggcaaacgatcaaagattacgtttgaactaacagaagatggaagacagatgctctccactctgaaagggaaaaaagaagaagcagagacgagggttactttcttcaaaaaattgcaccgggaagtatttggcgaagaaaatttctctttcatcaattttatgatggatgtcaggttttacgtcgaagatcttcctgaagagaaaaaaccggcagcaattaaaattttacagacagcctttgacgagataaaaaatttataacaaggcaccacagacccatttctcatatttcacaaaacacataggataccatgacaaaaagcaccattcaggatactactatttgtattacacccgtcggaatcgtgaaaaataatcttcttgctccacctctcatagccggaaaagacggccttgagcataaccaggcatgtacttctgccatgaaagacatgaccgataccaatacccgtgtttcagagattattctctccgaagaattctcagagcttctcgagggtattgaagaatattcacatgtaataatcctgtactggggacatgaggtcccagtctccgggaggacaatgaagaaaacccacccggctggtatgaccaattatccaaaacagggaatttatgcaacatacagccctgcacggcctaacccggtattgatgacagtcgttcaactggtgaaaaaagaaaaaaaccggctctatgtatccggccttgatgccatcaataacagcccggtgcttgatatcaaaccatatgttcccctcttatttcctcaggaaggagtaatcatccctgagtggatgacaaagatcatgacagaatttcattcgtaaaggagatcataccatggaaaaatctcaggatgcaaagaaaaaaactgatagtacttcaggtgtgctgagcagagagatgattgatgaactcaaaaaagatccgagagctctctttaaagaagcgattcgaaagaatgatgcagcctcctgcctggtaaagaccgctgagattcatgggcattattgtccgggtagtactctcggtgttatggcaacgctatatggacttagtcttctgaagaaagaaacggccgattcggatggaatcatggagaaccttctcgccatcattgaggtgaatgcctgttttgcagatggtgtgcaggcggtctccgggtgtacacttggaaacaactcactcatttatcgcgatcttggaaaacatgccgtaacttttgtatccagaaatgaaaaagaaggagtcagaatccgtctgcttcctgatttcaagacctatattcataaagaggtgccggaattttaccctctcatggacaaggtgatcatgaaaaggaagggaacacaggaagaagagaaattattcagggaaaaagcaaccgaagcagcatttgcaataattacgtatccatttgaaaaactctttgctttcgagcgggttataccagttatccctgaacgtgcaccgataaccggcacgatggtatgcccggaatgtggtgaagaggtcatggaaacaaaaacggggaaacgtggcctgctccggaatatgtgtttcgcatgtggaggaaaattccaggaagtgaatgggcagggaatcattgaaagaaacttccgggaccatggccatcatacggagccggaataagaggagagtgatcccatgaatgaatcacatatttgtaaaggagctctgcatatgacacagcccggcccaggacaccggagaggaaaaggtccaagtagtttttggatgcaggatccggatatcgtcttcagggaattaaacctgaatgaaggcgatacatttcttgatatcgggtgtgggaccggagattatacaatccgggcagcaactgaagttggcaggaatggaaccgtttttgctaccgatatacaggaaggacttgttcatgaactcatgaaaaaagcggaggattcaggactggaaaatatccaggcatttgtaaatgatattcaaaacccattgccatttgagaataatagtatcgacatatgcttcatctcaacagttctgcatagtcttgatctgaatcagactggaccattgctacttcgggagataaagcgtgttttaaaaaaagacggaattctagtgataattgaatgcaataaagaaaacctgacctttggcccgcctgtccacatgcggatatctgcagatgaaatagaaaaaatcgtgtcgccctatgggtttgtccagatctcccatgctgaccttggttttaattatttagttacgttcatcatccaaacctgaaattcttaaattttttgggggttcagatataccaattattcagattatcccttttggctcttcgacgcaataaatgagttcgtcaaattttttttatccgtaacttaagttgaaactggtatcaaataatcatccagtcatttcaaaaaatatattggttaaaatttaaaaaacatgaactgctgaagctttaaatgtaagatatacttcttcatcttcggtcaaatgcatttcatcccatcctcttctggtcatgactgatactattggtatcccaacatcaatagttactttgattaccatcccgttatttttaatatcagtgatcctgcctttgaaagaatttcttgcactggaaactataggatcccgggatagaagaatatcctcgggacgtactgttgcatacacctctctttctccgatgcaggttgctgaatagatagtatacccatcaatcttgatagcggagataccctcctgatgagaacattcccctttaaaaatattttccataccggtgaatgcagcaatgaactctgattccggttttctgaacacttcatcaggatctccaatctgagatatctctcccttattcataatagcaacccgatctgccagagaaaaaacctcctcaaaattatgagtaatatgaattactgtaacattggtgatatcatgaattctgcgaagttcagtccggagtttgtctctggtctgaccatcaagagcactcagtggttcatccagcagcagaaggttcggttccataaccagggaccgagaaattgcggctctctgttgttctcctccactcagggtttcgggttttcgatgaaggagatgatcaatgctcagcagtctggccatctcaagcgtcttctttttgatgaattcaggattttttttccgggtctttaaaccaaacccgatgttttcctctaccgtcagatggggaaaaagcatgtaatcctggtataccatgcagatatttcggtccttgggtgctaaattggtaatatccttcccatccatgataattcgtcctgaatcgggagggtaaaatcctgcaattgtttcaagaagaatggtctttccagcccctgtcggaccaataattaccaggtattctccgggagaaacatcaagagtcacgttccggagaacaaattcacccatgtctttagataaattctcggtatgtaacataggaaccccctataatcttgatgccccaccataccgctcgaaaaggtaaagtgatatcacacagataatgatgagaatcgtagctgctgaaattgccatattcagtttcccacaggacatattcaggaataatgcaatcggaagggtttcagtcttccattggattgctccggctattaaaagagcagccccaaactctccaattccttttgcccaggttattacagatgcagcaaaaaagccggaaccagccataggaagggtcacccgccaaactgcctgggcatcagtacacccaagggtttttgcgacaaattcgtacctggtgctgatggattcaaacgttgaacgcataatcctcagcatatagggaaaattcacaaaaaactgggctgcaataatcccgagcggagtaaatacaaaaaccaggcccatatctgcaagtgcatttccaaaacccgtcgtcccaaagaataagagcagaccaagacctgcgaccagagggggaagagcaaggggcatgtcaagaattgcattgaccgcatcttttccaaaaaaattgtaccgggcaagagcatatgcagcgggtaccgcaataagaatacagagaaatgttgagattattgaggttccaagactcatgactatggcaaactgaatctcaggacttgttatagaagcatacagagcatcaggagaaggttttgtcacaatgaggagcagtagaataattataaacagagtaagcaggatactggttccaatcgttgcagatctcagccaggaatttctcatgtcactcattttttaaccctttcccgattcctcagttcctttggagtactgttccattcggcaatatcatccatatgctggttatccacccagccacactttacctcatcgcgatggtcaaactgccttacatatggcttgatatcaagaagtggtgttccatccagtacatcaactccggaaactttcaaaatattatcttgtacttcaaggagctccataatcgacatacccatcggatttggccgattgaaatgacgtatggcaaaaattcccctttctttttcaccatcaaggaagggtttctgtaccagattttttcctgtggcccggtggaaataatagaatgcgtaaatatgagaaaatgattcgacatctgccagtcctgccttaaattcatcaaatacttctatgtatccaactgatggattaaaaatcccctgaataggagtattttcatgctcagtgtggtcagaatgaataattccgatgggatgaaatatgatgtcagtatctttccatttgactccgtattccttcgataaactcataatatgcctccaaaaaaaatagggaaaataagagagaaattacggagttaagcatccccgtacttggctaacggatagatctcaaatttatgttttgtgtaaatttctttcccttcatcagaggcaacaaaattcataaatttctcagcctcttccttgttttctgagaatgtcagagttccgattggaacaacatctactttaccaatctcttttggtatctcaacaagttccatactttccgggttgaaaagttcggtccagataagtgcagcgtctgcctgattcatggagacatataccagcagttcattgactgtacctgattttacgacaatattcttctctgtttcattccagagtttattcttctcaagcatcttctttgttgctgctccaaccgccggaccggatggttcaccaattgctaccctgacacctggccgtacgagatcctgaacaccagtaatattgccagggtttcctttcgggactgcaatcgctaacacatgatatacaatatcctgagatttatccacatatcccttatccatggcagactgaatgtacgagcgtgcaccaggcatgtacacatctcctttttgatataattcaatctggctgagcaactgggcagatcctccataggtatattcaatttttgttccttctttctcttcatataccttggcaatctcttccattggttctttcattccagccccgcaatagacaagaagtgtcttggcagatgaggaattctgttcaacagcctgctcctttaccggttcctgtgccaggttatccgactgattgctagaagtacatccacacacaagtaatgtcgccattaagacgaataaaatacaaaaaatcgaaggtatcgccttcataaaagaatgataaattaagcaatgataaagattacgaaataactcctaaaaaaccagtgagaatcaataatcctcatttgtgaatctattttttatcattgtggattaagtagctttacaacgatgaattaggtataaacatttggcataacagatgatatatcaaagaagagagaaagcgtgaggaaaaaatagcgctcgtgaatgaaccttatcataatattttacataaataaatttaatcggattatctagaatttaaaagcacatttattttaccaattcttatactccccaccatcattcgtcaaattcatcacccccattctgttatttcaaaatatataatttaattatcggggccccatctaaattaaaaaaaatgattagtcgaataggggaattggattactcctctccccccttccaagaacgcattgtgcgattttcaccgcaatacgctcaggttcttcactacccgcttttatgggcgcaatagagaaacatacgaatcgacttttgtgttgaaaggaatattcccggtcttttatcaaaatagacagaatctataaatgggtttttatccagtttaaggaatcttctgtattgaatcttcgtgtccgagaagtttgcaagagttacactcgccgttttaaaaacagacttacgggtcaaagtaggttgccagtatttcctcgctatccactttttccctttgttattatgtctgcgtttcgcccatgtccagagcatattcctgagtatccaatccagtttctggaaggttacgcttgatgatactgttttatggtacatcgcccatcctcggatgattggatttaactttttaatcaggtcttcttgtttccaagcttttgcagacttaatgacctcgctcagtttatgagtgattgcagcaatagctttctttgaaggtttaatcaggagtttacccttgaattttcgaaaattccatcccagaaaatcaaaaccatcatcgatatgaacaattctcgttttctcctcggagagttcaagaccacgttctttaagaaaatcgataatgaccagtttacactgggctgcagtctcctttgattcagccgttacgaggaaatcatccgcaaaccgaatgagatgcaccttctttcccggaaaacgttcctttagaatttgttccataccgtcaagagccatgttagccagagttggggaaataattccgccttggggcgttccagattcattacggtagagtattccatcaaaaatgtatcccgctttcaggaattggttaagaactcttgtatccatggggatgttggttaataaccaggagtgagagaaattatcaaagcaccccttgatatcgccttcaagaatccattgggcagagtcttttctgcttaaacattgaaatgcatatgcagctgcatcctgtgcactgcgattcgttctgaatccaaatgaggttctgtctgctatggtttctgcccatggggtgagagccattgcaaacagtgcctgcattgcacggtcgtacattgtgggaatggagagaggacgcattttgctcgattgaggtttggggatgaaggttcgccggagaggtttagcctgatatcccttgtctgaaagactaagaactgctctcatcttatcctgaggagtactccatttttctccgtccactcctgcactttttcttcctttgttgccagctacccggtgaactgctaacactttggcataatacgaatgagttagcaggtactggagacgctcagcaagccgataattgccattctttactgcttttgcgatacgtgtctggagtcgcttgacaaacgcccttgctttcttccatgggaattttcgccattgtttggcaagagttttgtccgagacgtcctcgctgtgttgcgtaattgaacttatctcgttcattataatccatcctgctcgccgtgaaagaaccagctgcacgtcagcaccctttcgggtcagggcaaagtctgaacccttatccacaaccattacagccgggcattcgctttttgcagcatcctactcccactacgcatatagtcctcctcacgaagttcctacctaaaaaaatttttttttttttttaggagcgtattggggtttccaagttcaataaaccagataattgtggtattttaggactcgcccatagaccggaaccagctacgtccattcgtaccagcatcactcaaactactgataccgtgattctccctcaatggggacaggggcaaatctctttcctcctgctatatttaacgatcctgcagcgattcaacgtttgtttgtccatgatacctttccctagcagtatatcccaatgagactatgggagtaaccactttgttcctgcagcttcgcacccatttattgctaaacacgcacgtgcaggtagggacacccagaatggattggggggctttttttaccgaattaaaccggaatagcaatctgatttaccgcttcttgtcgcactgagatccaataattctgacaccatatagattttcatagggcttttaatgaatgaacaggtattctggatgctttttccggctccagatccatgaagagatttggatgtgcccttttcgttcggtaggacacatatgcaatcggagttttttacaaataattacgactcatcgttttttcccgatggtgcactcaacttctccaaccggagtctgaaccggcctgctcctgactttataaaacccagcatcgagcatggcatttgcaataaaatcttcatgaatagccatattctgtcccattagatcaggaagcagcatcgaaataaccatctcctccggtttggtaccattccgtatcgttccatctgatatagttacaaacactcctcccggtcttaatgcctcatagatctttttcatgagagaatcaaaagagccaagggcataattcagggtcattgaagcaaggatgagatcatactcttctcctatcgaatcattcaggtaatctccggacatgaccgtaactctgtcagacacaccatattcagcagcacatcgcctcgcaacctctgcaaccgggggttgatcaaataggactccattcatggtgggatgatcaaggatcagggcaataccaagaagacccggaccacatcccagatcaagcattcgggaaaagccattatattccggaagtgaagatatcagttttactactatctgagccattcccgaccgctgataattgatagaaccccgggtctgcatctcctgaaactccctcgaactcataataatctcattcgcaccactatcaggtccatcacgaacgagtcttgagatcttttctggatgaattgaataccagggatcacttgcacaaagataatcacccagataggtgtcatttccctttaccagaaaatcatgagcaataggagaattgtagtaacaatcaccatctttttggatcacatcaaacgcagcaagtgcattcagaagatgaatggtgttttgtttgtgaagatgatgtgtttgcgcaatatcttctgcagagtgagtcttttccagcagggtaaaaagatcaagttcaattgcagcaaggagtatatttgcctctgatttcttcaggaggagatcctgaagaggtttgaaacttcgttgaatatcaggaatatccatggattaatcacctttatcatggtcatggaaatgatgcaggtccggggtatgaggatgtgtatgggaaaccagctcatgttcatggggatgggcatggacaactcctttcatagccggatcatggtgatgattatgatgcccatcatcatgactgtgccggtgctcatgcctggacgatacatgaatatgacgatgactatgctcttcggtggcaatcagccatgcaccggctgccatcaggggcagactgatgagtatctgtaatccggggttctcaccggggagtggaagagagaggaccagaccgataaatggagctgttgcaaataatgcaccggtcctggcagaaccaaggactctcatcgcccggatgacaaagaatattgaaaccccataccccaggcacccaatgaggaggactaccgggataattgtcagggacggggccggttctccgatagcataccccaggcagacactgaatattccggctacaaatcccttgatcatgacaatctgggcaggttcctttccggatataacccgggtaaaattattgtccataccccagcagcaacatgccagaattatcaggactgaacccgttgagagcccaaaggtccctgtaggatcatatgataaaacaaatccaccaagaacgactgcaataattgcatacagcccacgtcttcccagcggttcacgaaatccaatcaccgcaatgagggttgtaaaagccaactcagcattgaggagcagggaagcagttgatgccggtgtggtggtaagaccgaccatgcagaggatagggccgatgatgctgccaaaggctatgatcccaacaagccagggaatatcacttctccgtataggagcctcggtttttccttcgggatctgtaaatcttcggatcaaaagccccccggcaccggctccgagatacaggagcccggcaagtgtgaccggaccgatatcgaaaaggagaatacgggaagcaggaataactgcaccaaacaggactgcggcaaggagtgccatcaggatcgcgtcccggttggcaggttgcatgataagttatagtatttgagatcagataagctctatccagcctaatttttccgaatacccaatctaaaataattatttctaattgaataccttttcggatattcgaagcatctccaatggcatgcacgtaccgatatctttttaagaaaatttttcctgaatccacatattactaatatatagtttgagaacaatccatatattactaatatatggatccgttctcacatcacaatcttgaaaccgtcctgatcaaccagattcagcggtttaaaaattcaagcccgggaatacaaagaagaattgacttttcacagtatgtgaaccaccctcaaataattgtaattaccggggttcgaagatgtgggaaatccaccctattgagacaaatcgcggactatttttcttcgtatttgtatgttaacctggatgatgaaagatttgcagggatgggaattcatcatcttactgaaataatgacaatatttgaagagaataatccaggtgttcgaaccattttccttgatgaaattcaaaacattccagaatgggagaggtttgtcaggaggattcatgatgacggatatcagatttttcttaccggatcgaatgcgcaactcctgagttcagaacttggaacccgccttactggcagatatgttaccatatcactctggccattcagatttgatgaatattgtaatggtttgggtgtgacggaatttccacgaggatcacaggctgaagcagaagttcaacgattatgtgtaaaatatctggaagaggggggatttcctggttttctgcaatataaggatccggagatattacatcagatttttgaaggcattatctatcgtgacataatcgtccggtatggaattcgcgaaattcttccctttcgtgaattgtgcagatacctctattctaatctgactcgagaggcttcatatcaatctctggcaaaatctattggcgtaaaaaatgcgatgactatccggtcatggattggatatcttcaggactcctttctcatatctgaatgctttaggtttgattatacactccgtcgtcagcatgcatatcagaaaaagatgtatggggttgataccggccttcgaaacactgtatcattcagattttcaggagataccggattgttgtttgaacaggcggtgtggatggaatattcaagccgtgggcatgaactgttctggtttaaagcggacggggaatgtgatttcttaacttttaaccaggggaagatcaccacctgtattcaggcatgtactgaattgaccgtggaaaaccaggaaagggagatatccggattgctggaagccatgaaagagacgcaatgtgataatggaattattctgacaatgcgacaatatcaggacatgattatcgatggaactccgataaagatccgcccgttttggaatgaagttctatctaaaagccagttaatacgaaagtcaacgtggtaagttcttatcatcaaattaaaaaagaaaaaaagaagagtatctcgttatgataccggagcatcagtcggggctatggtattactcactgtcggaactggccggggtttataggttgtagtcggagccggggttggtttctggttttcaacttcacagagttcatttactgagggatgaagtggtatcactgatgcggcaattgcggtaaactcttctgtctttgcttttgcatcctccatggtctcatacgaaccaaagactgccacgacatttccatcgatcagtcttaagaagagatttgacgtctttccatcagaatatttcccatactgggtaaccgtatcgttgccaaattcaggttctgaaagggttgcaatacctgtttttgcattaaattcatcaaggttgactttcaggttctcctccattaccttggaacaattcatattctgatatacctggattgagatcacattggtaatatcattgttgtccataacgccggtcgccattcctgcataggagttgaccgcaaaattagaccagtcggcgggtaatttcactacgaactggtcgttgattgtctggttggcggatgatccggactcggctgcagagactgggataaggactgcagcaattaaaaggcaaaaacaactgcataatcgaaatagatccatactatcacgtacggttcatacgattatgaattttctggtcagagaaacaatacccccctgtcatactatagagaacctctccatcactccttactcagctccattaagggcatctgcatcaaaataccctccttttgtcatggaaaccagctgatctataaaagcagacgggaaaacatcaagttcaagaaagatatgtgcagcaaattctagaaatcccagcgggttggcagttataatgcccttgtcagagatggacggtgagggagtgtagtactgttcgccctggtattgtggtgcatgggccttcagccactcgtttcctgcacttgtatgccgtacgtcatcaagaaaaccatgcctggcaagaaataaggtccccccacagatggctgccaccgggatctgtgcctgagtacaccgggatataagggatgccagctgatcaggatcctccttctcataatatattgaaccgggaaggattaccatggcaacatcatcaatgttcacgttatcaactgaaaaatccggaacaagggtcagtcccccaacggaccgcaccggctcttgtgttactccaaaggtgcgaaccgggtaactattgtttttggggatgtcggtatactgatctgacagcaatgatattgtatacgcaggttcccagtctgccataccgggacaaagaaagagaaaaacactttttgatgttgtcattgagatctatagtaatctgcacacagatcatgtacccattgtcattccccgatgtttgatactccctcctattcagaaattgtgtccgcgatctgatcctcgatctagaaacacaaaacaaaaacagagacaaaatcatgtggattagatttttagcgtcaaaacaaatcatttgcgataccggagtcaattgagacctcctgaatcattcactataccaaacaaatccaggatttaatttaatcttctcttttatctccaaattaccgattcattagtattatttattatttcttgataacactaattttatatatacgtacataaaaatttagataatactaaaaattaggtgactcatgtccacggttactgttgaacaactcctccctggcacatcaggaattatttcatcaatccagggagaaccggctattcgccgaagattaatggaaatgggcgttctgccaggttctgaaattactctaatgaaatgggcaccgcttggagatcctgccgaatgcaacattcgtgggtacaagctctccctccgaagggcagaagcggccttgataaccgttgaaccaaagaaggggaagtgaatgagcaatggttcctcttagccttacaaagagcggtgaaaaggttatagtcaggtcaatctgtgggaccggccacctggcaaaaactttgggccaactcggaatcattatcggaatcgaacttacgatcattcaaaaagcaaaagaatcggtaattgtccggataggagagagcagatacgctcttggagccggagcggccagtatggttctcgttgaaccactttaaagatgacattatgaaagatattcgtatattacttgcaggaaacccgaatgtggggaaaacgaccctgtttaacagcctatgcggggtacatcagcacaccgggaattatcctggagtgacggttgagataaagacaggaaaacgtcagatgaatgaacactcaatcattgtatctgaccttcccggaacctatagtctgtcagcatttactccggatgaacaggttgcccgtgatgcactcctgacatctggtccagatgcagtggtccagatcattgatgccacaaacattgagagaaacctgtttttaaccacacaactgatggaaatcggacttccgatgatcatcgccctgaatatgtgtgaccttgcagaggaacagagaattaccatagatgccgattgccttgagaagaatctgaagattccggttgtcagaattgttgcacggaaaggagaaggaatagaggaattaataaaaaccatcatccaggtttccacaaataaaacccccgtcgtccacagagcggtcgaatacccccattcggtcacatcccacatctccgaaatcggtaattatctcagtgcacacgtatcacttttaggcagtctttctccttactacgcagcaatacggctgatggaaggcgacgaacaccttgaaaagatgctgcatgaaaaaggacttaccattccattcatcgataccagtgatccggcagagcgggacggtattgcagaggatattctactggccaggtacaaaacatcagaggagatcacgacctgctcggtgaaatgttccatgggcagggtcatgcccggagatcttatcgaccaggtcctgacacatcggttattcgggatacccatcttcctctcatgtatgtggtttgcgttccagctcacctttagtgcttccaatccgttccttgttggaatagaatacatattcgggtatttcaccgaccgaatgaacagcgtcgatatggatccatttgtcagatcattcctatctgacggggtaatcggcggactaggatccgtgcttgtctttgttccaagcatatttgtcatgttcctgctgctctccatccttgaagatacgggatacctggccagggcagcatttgtcatggaccggcttatgcattcagtcggtctgcatggtcgttcattcattccgttccttatcgggtttggatgtaatgtaccggctatcatggcaaccagaaccctgcagagcaaggcagacaggattattaccatcatcaccattccgttcatgtcctgtgcagcacggcttcccgtatatgtactctttgcaggagtattcttcggagctgcagcaggaaatgtcatattcttcctgtatgtcctcggaatcgcggttgcaatcctttcggccctgatatttaggcgactggtattcaaggatgaaccatcgcccttcatcatggaactccccccataccgaaaaccaagtggatttgctgcagcggttcacatgtggttcaaaggcagggaatacctgaaacgtgcagggcttgtcatctttggcggggttatcgtcgtctgggcattagcaaccctcccggcaggagttgaatatggatcagcagacagccttgcaggaatcatcggacaggcattacagccagtatttgctccgcttgggtttaactggcagctggtcgtcggactcatcttcggattcatcgcgaaagaagtcgtcgtcggatctctgggaaccctctatggaggagaagagatgcttgaatcatcccttgctgcagacccgaccttacatccgataattgcccttgcatacatggtctttgtcctcctctaccttccctgtgtggctgcactcggggtaatcagacaggagatgggtaactggaaatggaccggaatcgcaatcggatgggggatactcgtcgcatatgtcttcgcgttcatcatattacatgtaggttcactcgttatcggagcataaacatgaataatacaacataccctcaccagtatctctatgggtggacaggaatcgtgacactgaccaccggtatcgccggtatcatatcaatattggaaggagccggaatagggactggtcttttcatcccggatatccccggtggatgtatccttctccttatcgctgcactcttcgctactgcagtcataaaaggcagaacagaccgtccgggctggatcagcttctcctacatcggggccctgctcctggtagtatttgccggatgtgcaatcctggttgaaaccggtaatttccttaccctcatcatggagggtgaagaggcacatctcctgactatcgttagttcatctttcatatgggcagcaattctcgccattccccttcttgccggagtatcaaaactcctgtatgggtgttcatgtggaggtgactgctgtgagtgaaggtcttgaaattcttcagctcatcagtaaacggggaggatgcctcctctccgaacttgctctggaacttgatatcccggtacaatcagtacaatcctggatatccatgtggtgcagcaccgggtatctgaaacgggacgaagaagaatcaaaaggttgtgcatgcaggaaaagcggtatgaaatgcgtctgctgtcattgtacctgtgaagaaaagaaaaatttcagtgaaagcagagtagaactcacgcagcggggacagacccttatcaggaggaaatgggatgaaaaaacaagttcagaaattatctcaggcaatggaagattacgtcgagacaatttatgtgcttagtaaagacaaaggatatgcacggactggggagatagcaaggtcactgaacgtctcaccatcttccgtggttgagatggtcgggaagatagcaaagctcggttttgttgaatggagacggtatgaagggatatttctctctccggagggcagattgcagggagaagccattcacatccgtcatgaaacactgcgacaattttttgaatttatcggggtttctccggatattgcgaataaggaagcatgtattatcgaacatgagttatctcccgtcactacttctgccattggaaaccgtatacattttttgggcactccggcaggatgtcagaccatttctgcacgaaaactctttctgaagatgcagaatcccggaatttcgtgggataatgcagctaccgtccaggaaccggttctaaaagagatggtcatgcactcagcacggaaatctcaggcaaatcatgagatcttatcgcttattacccgccatgacctgctcaatacgataaccgccctgtaccggtacctggatctgctgaggaccatgacgaccagtgaagagatgaaacttgttgtctcacgtatcgaagggacagtccaggcgatgaacagacaggtatcaaccagttcagatcatctcattccaggtcttgcaggacagaaatggatgaatcttggtcagctcatcacccatgcagaatcactggtgctcttaggatcagcagtcgttgagcaaaatcttgatttaattgaaatattcggagatactttgatcgaaaaagtggtatataacctgatagacaacgcaatcagacatggagacggggtgaccaggattacatgcggttatatgcagaaggaaaactcgctggtatggtttatccaggatgatggcatcggaatccctgacgagtataaggatcagctgtttcggacatctgcacagaataacagaggaaccggcctgtatcttgcatatcaggtcctgagtgcctgcggtatgcagataacagaatgcggtacatatggagaaggagcacgatttgagataatgattccaaatgggctgtaccggtttgtgaacatgcccatacccaaacccgaaccggttttgcctgacatcagtcaacccatatctcatccctgctcatttcaggttcaataaattcttttttttttcgtatttttttattccatttctataagaggggttcattggataaccaggattattcagacaatagattttggaaaaaagcagtaattacaaaattctaataattttttcagataatcaattcgttgagagaaaccaggtgagatcggataatctctgaatcatccaaaacagacactaatggagctgccggaaaggagggatctctgtcttggtttattcaggtgtggagattacacgatcctgattgtctgtcatttcttcatgaccgcagatgataaccaatagttaccatcaaattcagacaatagtgacgacctgcatgaccattataatttattatctgtgatatcattcacttgaacagtacccatcagctgagtatcatcttctggaacatccatatatttccaaagaaattccggaatgagatccagtgccaatacccctctgatagatgcatgacttcccatgtgacctccttgtgtgaactgattttatccgcctaaacaaagatgatgtatctttgtttgaatattcatccaacagaccgatccatttagacggttcggaatgtatggaagattgcgaggtttcatccatcagtgatggagatgctcgtcaaggtttttaatgtgactgatgagagcttccaggtcccgttgaacgtgttcgatatccccatgaacatggaagagctcatctttcatatgagagatgagatctgatttttcactcattcaatactcctggtttgggattttcactcccgcatatcactttctgttttttggtagagatgagaggtgaccgaaaaaatttctgaaagaaaaaagtgacaggctatgaattcagaacagaggggactgactcatgaaactcagcaaaaatcttcataaccctcccttcagtatcccgatatgaagttgcgtacaagaagatctcctgttctctgtctctgcaggtaatggtgaacgaattccctgtcacatacccggttcagggcatcatatcattacagatcctccggattttatcaggaagaggaaaccagatgtttaggaatacatatattctataagtttaaatatctgcatatcaaatagtttgttgttcaaacattatgatgttcgaagtgaaatgatcatgacagaaaaagatcagctcagagaagagttaaacgaaaaactcgttgagttctttgaccgtttcacatcatgggaatcatcggtcattgaatctggaaatatgaagatatctgatgcccatgccattgagattcttggtcatcacggccggatgaatatgaaagaactggcaggcagacttggtatcaccaccgggaccaccaccattgctgttgatcgcctggagaggggaggatttgccagacgggtcagggcagaacatgaccggcgatcctatattattgaactaaccgaggatggtgcactggcatatgaagagcatcaccgccatcacctgaacctggcaggagaaattgcctcgatcctcggggaagatgagaccagggctttcattgaaattttgcacaaaataaatgagcatatttaaagcaggtggctcacccatgacttctggaacgagtacctgtgataggaagacctgctgctctcatgattgtgggtgtacccatgaccatgcggaagaggacctgaaaaagactatcatacggctgctggtatccggcttttttgtcttcatcgccgttctgactgaatatactatcatctcagttgcagacgtccagatcccggcagctcttgcagcccttgccctcactgcctacccaatcattaaggaagcaatcctgggaattagcagaaaagaatggaatgtctgtgaacttgctgcccttgctcttgttgcagcggtgctgattggagaatttactgctgctgctgaaattgcactcattctcacaataggagaactggtggaagactacctctttaccaggacgaaaaaagacctgaatatgatggtgcaggcagcccccacgacagccagtctcattttgaatgaaaagattcacgaaataccagttgaggatatcagagccggtgaccagctcatgatccatccgggtgagagaattcctgtggatgggtatatcgtcaccgggcattcggacgtggacgaatccttccgcaccggagaaagtctcccaatcaacaaaaaacccggagatgctgtatactcgggaagtatgaatcttgacggggcactggtcatttccgcatcaaaccctgccactcagtcatcctatgcaaaagttgtggaactggtaagagaggcaggacttcgaaggcctccgtcccacccgatgatagatcggtttgcgggttattacactccggtcattctcatcattgccggtatgattgcccttgcaaccggtgacataaccagggggatcaccgtgcttattgtctcctgtccctgtgcactcctccttgccaccccgtctgctgtccttgcagcaatcggccctgcagcgaagcgggggattcttataaaaagcggaaaattcctggaggtatgcaagcagattaccatatttgtttttgataaaaccggaaccctgacatcaggtgagatgaaagtaacatcagtcatccctgaaaagggacatacagaagaggaaattcttaccatagccgcctctgctgagcgttcttccccccaccctattgcgaaatccatcagagaagaagcccgaaaacggggtattcagatccctcaggtgggcacagcacggcacattcccggtaaaggagtagaggatatatggaacgggatgccaattctcgtcggaagcagagaatttttagaggaacgctctgtacctcttcccaagaagcctcattcaaatcaggagccgacccatgccaatgagaccgaggttctcgttgctcaaaacaatgaatatattggtacactatacatctccgatacgctgcacaccgataccagagaggccgttacatctctgaagcagatcggagtatataaatatgcattggttaccggagaccatacaaacgtagcccgatctattgcagcagaactccatatccctgatgacatgactttttccggacttcttccacaggataaagagacatatatcgcaagacttcaggaacagggggaggttgtatgttttattggagatggaacaaatgacggtcctgcactagtcagggctgaccttggggttggaatcggaagtcgtgcaaatacccttgccctggagagctcaggagtcattctcatggaaaagggtctttcagcccttccgttatttatccggttaggcagaaaaaccagccagacgatagcacaaaatatcggtcttgccctgttcctgaatctcttccttattagtatcgctgccggcggggctataaccccggtcatgggggcaatcggtcatcagctggcgaccatagtggtacttataaactcaatcagactctcctgttccctcccggcataacctttttctgcatagcatatattcccatatacacgaattatacgaatactatcggaacaagctatcagtacagaggcgaagtgttttatagtgataaatggttaatcagtactatccgtaatggttttccggttatctgcatcattagatgcaaaaatcagaccatataaaaaatacgctgacagaattcatccccccaaaaaaccatgatccatatcctctatgtagatgatgaagaactccttttggaccttgcaaaactatttcttgagaggagcggagaatttgtcgttgacacctcaataactgctgtggatcttgcagaatcaccatcaatcagatcctatgatgccatcatatcagattatctgatgcctgatatggatggtatcgaatttttaaaaaaaatcagggagaaatatccggaaatgcccttcatcctcttcactggccgggggagagaagaggtagttattgaagccattaataacggggctgatttttatctgcagaagggaggagacccgaaagcccagtttgctgagctcagtcacaaggtcatacaggcagtgaaacgaagacaggctgaaaaagaactccttgaatcagagcagcagttttcaaaggcgttccatgcaaatcctgcaattgcggggctgtctgatcttgcaaccggcagatatgttgatgtgaatgatgcatttctcgagcggttatcatatacacgggatgaggtcattggaaaaacgtctctggaactcaatgtcctgacaccagagaaacgaaaagaacttatccatgaactggagaccaaggggcatcttcacaattacgagaccgaaatcaggacccgtacaggagaaattctccatgtcctcatatcaggcgatatcatactctctggtgaggataaactcctgcttgtccaggcggtagatattaccgatcggataaccagtgaagaagcgctccgtgagagtgaataccggcttcgttcctttattgaaaatacagcagatgcagtcattctgatcgatgaggaaggagagattatcgaatggaatcctgctgctgaaagaatttcaggcattttaaaagatgaagcacgggggatgaaggcatgggacattatgccccggatgatgctcccagaaagaaaaaccaggcaccatctggaagagatggaggcacggataaaagaatccctgaaaaccggaataccggcatcacagcaaccggtcatttcggagatcatcggcccggacggtttaaccagatatattcgacaggtcacctttcctatcccgaccagtaaggggtacaggtttggaatcatcatagaggatataaccagacaaaaaatcactgaggaacaggccgaaagaaatctcttaaatctgcagagaagccagagcatagcccatgtgggcacctggacgcttgatattgccacccaacggttctctgcatctgaagaagccctggccttgtttggatatccacccgattccaccccttcattagatgaaattgtccacatgatccatcccgaagaccggatacggatacgggatgtattcgaaagtgccctctcaaccgggaagtcctacaataccgagatgaggatcattctcccgaaaactggagagcaacgctatctctactcatttggagaggctgaaaccgatgaagagggcaggccggtcagggtatttggtgtcaatcaggatattaccgaactgaaaaagacatcattcgctcttaaagagcaggagaaccagttcagacatattattgacaaccttcccatatccataagcatagtcactcctgatggcaccatccggtatgcaaacccccaggcaatgactctttttgaattttccagcatggatgaactgtacaataccaaggctcctgatgtctgggctgacccggggcggcgtcagctctggcttgaaacccttcaaaagaatggcattgtcacaaactttgagatggatctgaagaccccgtcaggaaagaaattctgggcgattggatttgggatttttatcacctatgaaggtgagatgtgcatattgtcagctcaccacgatatcactgaccggaaacgtgcagaggatgaactcaaaaagcgtgaagaacagtatcgatttataaccgagaattccatcgatgtcatctggaccatggacctttcaggccggttcacctatatcagcccctctgtctggcatctccggggatatacaccacaggaagtgatggaaagtactctggaagagaccataagcccatcatccattgacatggtaaagaaaatactagaggatgcacagatgctgataaaacagggaatggctgtaccccaacaaacctttgaggttgaacagccctgtaaagacggatccagcgtgtggaccgaggtaattgcaagaccactctatgacaaatggggcgatcccatcgggtttatcggagtcagcagggatatcacgaaacgaagagaggcagaagagacgttacgggacaatgagataaagttcatctcaatatttaaccagactcctgaccccatccttatcatagacagttccgggaaaattcttgaagtaaatcatggatttcatgacatgttcggcctttctgatgccgatgttctgggaaaacaggtggacgcgataccggcggtatctgcagtggcgggaagcgatattcttaaagaacggaccgggagaggcgatgaggtataccgaaaggagatgatactcacaaaccggatgaatacacagatcattgccgaggttgcatggtcacaattacttattcatggtcaaccctgtctgcttattcagattcatgacatcagtgagatcagaaaagcccatgatgctgcccagaaggcaaataataaactcaacatcttatcgagcatcacccgtcatgatatcctcaaccgggtcatgattgcatcgctttatagtgatgagatcaaagaatcagtatcagatcccaccattctgaagtatctgaacgccatctctcaggcgtcagcggatattgaacacctgatcaggtttaccaaagaataccaggacctgggaacggcagctcctgcatggcaacagatccagtcggtattcagtcagccgggaatcatcaatctcacaaaaggcatcagaattgactcatatctcggaaagctagagatatatgcagatctcatgctcgagagagtgctttataatctggttgagaactcagtcaggcatggacagaatctcactcatatcacagtagcatacgaagttcgggacaccgactgcatcctcacctatgaagatgatggcggtggtgttccggtagaagagaaggaaaaaatatttgaaagggggtttgggaaaaacacaggaatgggattgtttttaatcagggagattctctcaatcaccgggatagagatccatgagaccggcatctatggttcaggtgtacgatttgagatccgggttccatctggaaaatggcgccaggaatagagatgatactacaacatcaaaatccaggagtccccgtatatgatcacaggaatacatcccttgacaggataatgccagaatcagacgaaagtggatatcacaggagtatctgatcgtcatggagaaggatgaacctgatctccaaacccggagttgtatgatatcacaccttcgtaatatcaggattccagataaattacccctcattctgcttattgttaccagtgtatctgcaattattattagtattatctctctccagtcaggttggacaacaatattccagaacctgtactattttccgataattatcgcctgtgcattttatttcctgcgtggctttctcttctccgttatgctcatagttttttacatcactcttatcttcctgtatacccgggatccctccatcctggccggggaagggatacgggcagttatattcacccttgttgccggaacagttacctatctttcagttcaaaaagagaaagcaaccacagatctggcagagcggaatatcgaacttcaatcggcatatgaacagatacaaagttcagaagaagaactcaagcagcaacttgaggagatatacactgcacagcaggagatagatgaccgggaacatacctaccgtcagctctttacctacaatagtgccggcatagcccttcatgagatcatctgtgatactgatggaaatcctgtaaactatcggtttatcgaagtaaatccggcatttactgagttaaccggactcagggaagaagagatcattggcaaaaccgtccttgaagtattaccaggaactgaacagtactggattgatctctatggcagagtagccctgaccggccagtccgcccatattgaaaactatagccgggaacttgataaatattttgaagttaccgcctattccccaagaaaaggacaatttgctactctgattcaggacatcaccgaaaggagcagacatgaggctctcctcaaagagacaaatgcataccttgaaaacctgatcaacaatgcaaatgttcccattcttgtctgggacaaaaaccttctgatcaccagggccaatcactcatttgaactcctgagtggatggaatgctgatgatctgaaaggaaaaactcttgaaatactctttccaccggagaatgcagcagaatcaatgcggcttatcaggaccactcatgacggggtcaggtgggatacggtcagacttgctattcagcaccggaacggcgagataaaaaccatcgtgtggaattcctccaccatttatgatcctgatggacaggtaattgcaaccattgcccagggaagagatatcacccaggagatccaccttgaagaagagaaggagaaactgaccacccagattcaggagaatattgcaaaacttgctatcctgaatgacggaataagaaatccactcacgatcataacttctcttatcgacatgcgagatatgatcgattcgggagagctggaaagacagatcagggagcaggtatcacgaatcgatgatatgatccaatctctggaccaggaatgggtaaattctgtaaagatactggactatctcagaaaacatcatcacattcacaaatacgcccggaatggggaaagaatcaagcagaagggcagcagcctgaaacatgaagacccccaagggcagttcgtacctgacagcaaaacactcttaattgaagaggtacaagcccagctctatacgatactggacagcattgatgctatcatctacgttgctgacatggaaacctatgagctgctctacattaataaaaaggcacgagcagtctttggtgatgataccgggaggaaatgttatcaatggctgaatgagggccgaaatgccccgtgtgaattctgcacaaatatgcggctggttgtgaatgcagagcctgccggcgtataccggtgggaatgtcacaacccatcaaataaccggtggtatgactgccgggaccgggctatcaggtggacagacggaagactggtcaggctggagatagccacagacgtcaccgatgagaaatgtatagatgatacacgaaattaccttcttcattcagattacctccagttcggagaagacttcttccagtctgtcgtccggtacctcaaagagatcctcgcagcatcctatgtctcaatcgatattctaaccggaaataatgaggcacaaacccttgcatcctgtcccggttttgatgatcgtgaatcagggtcatttccgattcatcataccatattccctcatgttattgggaaaaagatctgctcatatgaccacaatgtgcacctcgcttttcaggatgatcccctccttttgaacctacaggccaattgttatgtcgggacaacaatctggagttattcaggaattcctatcggagtcatctcggtcatttggaaaaaggaacctgaaaccctgcaccttgcagaacctcttctcaagatggtgtctgtcagagcatcaggagagatagagcgtttgcaggcagaaaagcgactaaaagagaatgaaaccagaatcagggagaaactctcctctctccttgaacctgaaggagatatcagcagcctggacctggcacagatcattgataccgacgaattacagcttctgatgaatgatttttacgcagtctccgggattggagttgccattattgatctgaagggaaatgtcctggttgcgaccggttggcaggatatatgtgtgcaatatcacaggattcatccggagacctgtaaaaactgcattgaaagtgatacgatcttatcacagggtgtatatccgggtacattccggttgtaccggtgtaaaaacaatatgtgggatatcgcaacgcccattaccataggaaacacccatattggaaatctgtttctggggcagtttttcttcgatgatgaagagattgacaaagaactattcagaaagcaggcacaaacgtatggatttgacgaagatgcatacatacgggctcttgagaaggttccccggtggagtcatcagacggttgatcatgtcatgcacttttacacccggcttatacacctgatatcacaggaatgctggagtacaattacccttgcacggacagtgaatgagcgggataccctccttgaggaggcatgggagaaggatgaggaattacaccaccaacttgaagagttgcgggtcgctcatacagaccttatcaaaacagaggaggcactcaaagagaacctgcaaaaattaagagatctgatagaaacatcaccagatatcatctgggagatagatgcaaagggaaatttcacctatatcagccggcaggtgtttgatcttcttggatatacccctgatgaactgctcaattcatcaattctcaaacttgtacagaaagaatcccacgagatggtccttgccgaacttgcacaacacctgcaattacctgggaaagttcattcccttatcgtctctgcacaacataaagacggcacagaacgaatcatggagattcgggcaaacccggttgtgaatgatgatggaattgtaatcgggatgcgggggattacccatgatgtcaccgagctcaaatctgcagaacaggagttactaagaagtgaggaaaaataccggcatatctttgaagatgctacaatagggatattccagacgacaccatccgggcagattatcatgatcaatgatgcaatggcacggatgtttgggtatgaaaaccaggccgaagtattcaggctgaaccggagagtagaccaggatctgtattccatatcaaaggacagaaaggcccttttagaagatctgaaatcaggccagccggtatttctcagagagatagaatttaagaaaaaagacggaactattttcacaggttcggtcaatgtccggactatttctgatgaaaaggggaaccccatcctctacgaagggacaattattgatattaccgaacataaacagatcgaaaaggcgattgctcaaagcgaagaacggttccacaaaatactcgatcttgttcctgatatgatctcaatccatgacccggagatgaatatcatctatagcaactggaatggattcggatcagttcctccagaatgccggataactggttcaaaatgttatacaacctaccgtggcctggatactatatgtcctgactgcctggcaggtaatgcattaaaaaccaaacaggcaattgagaccgaagtgaaactaccggaaggaatatggattgatctccgggtcattcccctgctgaacgatgaaggggaagttattcttttcatggaatgcgtcagggatattaccgagaaaaaacttgccgacgaagaactctgggaagagcggcagcgtctcgctagtataatcgccggaaccagggcaggaacatgggaatggaatgtccagacaggagatgtcaccatcaattccatatgggcagagatgctggggtattccagagatgaacttatgccggtgaatatccatacctgggaaaatctcactcaccctgaggatcttcctatcgtgatggatatcctggaaaaacatttcaacaaagaaaatagtcattatgatgcagaattccggatgcgacataaaaacgggaattgggtatatattcatgatcgcggacaggtaatgtcctggactgacgacgggtcacccctcatgatgtatggaacccataccgatattacagagaaaaaagaagcggaaaaagcactttttgaggcaaataagaaattaaatcttctctctgacattaccaggcatgatatcaggaactcactaaccagccttcttatcttccttgataaaaccagacttaccccaatttcagaggaaacaaaggaggacattgacagaattgaaaagattgcccttattatacagaaagccatagaatttactcatgaatatcagaatatcggtgtgaaacaggcagtatggcatgatattgcagcaatggttcaatcggtatcagagcagctgcaaaaggaacccgtcagattcagaatagatctgaacggtcttgaggtctttgccgatccgcttatggaacgggcaatattaaatataattgaaaatgctttccggtatggaggtcccgatctctcagagatacggatttactatgaagatgaatgtcaggatgaccatctctcatggataattgaagataacggagccggaatccgtgatgacgaaaagccacacctctttgagcatggatatgggaaaaataccggttttgggttatttttcaccagagagatcctggctattaccggcattaccattgaagagaacgggagttatggacatggagcaaggtttgagattcgaattccacggggaaagtggaggatggagagttaaattaaaatcacatgtacagaggatataagaactcatgaagagatttatagaaattacacattctttttcatagccagaggatgatgactttgaaaaaacttcccataggtatccagtccttttccaccatcattaccgacgggtatgcctatgtggataaaactaaatatatttcaaaactcgctctacagggtaaatattattttctctcacggccccgaagatttggtaaaagccttcttattgataccatcgattgtgcattttctggaaaacgggatctcttttcaggattatatcttgacacagcagaatcaggatgggatttttctttccaatacccggttctcagaattgactggtcagttgcaccagtccggacaccagaggagctcgagcggagaattcatgaaattctggacacttgggctcttcattatgaatgcaccccggttccctctacgagtgggggaaaattagattttatagtcagaactattcagcagaagaccgggatgcaggtagtaatactcatcgacgaatatgataaaccgatcctggataccctgaaaacaccgggtatcgctgcagagatgagggatatgttgagggacttttacggagtccttaaatccctcgattccagcctgaagtttgtgatgcttaccggcgtctcaaaatttgtaaagacagggatattttccggcctgaataacctgaatgatatcacgcttgacagatcatactctgctatctgtggatatacagaatatgatttagaccaggtgtttaaagcatatattcatgaatttgataaagataaggtcagggaatggtataatggctattcctggaccggagaacgagtatacaatccctttgacattcttcttctcttttccaaaggaatattcagaccatactggtttgagaccgggacaccgggttttctcatcgagctgtggaaaaatgctccacgtttaccggcagaatttgacgggatggttgtcggagaagaaattttaggatcttttgatcctgagcagattcgagttgaaacgctcctttttcaggcagggtacctgacgatccattcctgggagagtaatccggatatcgggacatggtataccctgggatttccaaaccgtgaagtaagagaatcctttaaccgaatgattctatctattctcggtccggatacaccgaatatatctgtcccggcttatcggacaattttggagagtggtgataccgagggattgcgtacccgtatccaggcattgtttgcatcaattcctcatgactggtacaggaaaaacccgatttctcaatatgaaggctattatgccagtgttttctatgcatggttatccagtcttggttttaccgtaatccctgaggatgtcacaaataaagggaggattgatctttcagttcagaccggcctcattacatggatatttgaattcaaggtgttcggaattgatcgcagtggagagagaaaccctcttgaccacattaaaaatcagggatatgctgagaagtacctggctgaatcaaaacaggtgattctggtcggtatcgtatggaatccgaaaacacggaatattgagcaatgggaagtggcaaccgaatagtacaatgagaaaatttcaggcgaatgattcagatacttgcagtaggtttatcccactctttttccagaacctggtgttttttatacctattgatgaaatgtctaatcgcgattagtactaatcatgattagagaatttgttataaaaatctaccggtcatactttgtgatcgaacattaaaaaccgaatcagagtatccagaatatgcatatcctgaccatccggaaattgtgcaatagaaaaactgtaatgcacatttttcggtaaaattgtgtaatatgatactttaattatgaccatgtatgacatattgattaccagatcatgtgaataatttattctttaaaccaagcatatctaaaagggagaccattcatccgctcgttccgctcacccatggaaacatcgaatcacgattaaacaatcatcagtttaattgaagaccggagtgtccaatgccggaatggtatcctgtactcctcctcctgatacaagacgggcagcataataaaccggagagggtacgtgagttgattgagggagagggaacgaagattgggtacgatcaggatcagagagacatccggagcatcccacaagaatgatcaccatgaggaagaatcccgatactttctgacccattatgcctccatctcatgaatggagatcccccgttctcctccacttcccggatggaacccatatctcaaacctggccccttctcccggtattccggtttcacgtatttcaagtccggtaatcgaaaggatctcccgtgataaaaagagcccgatacccgtatgtgctccatatccccgctggaagatgcgggccttctcctcctcaggtatcccgaccccgtcatcctcacagataagtatcatggatccactctcttcccgggcagaaaaccgaatcctggtaattgttctcccatggcggatggcattatcaagaagcgttgtgaatacctttcggatgatgggatctgcatagatggtcagatcagaaggaaccagattttcaataatgacctcaccaggagagagttctgtttttgcagattcgatcgccaaaaatatctgctgccatcctgacccggctatcccgaatgcctcatattcacgggtaaacccaatcgttgcttcaattcgttttccaatagcagaggcccggtccacaaaggtcatgcactcctctacattctcactttcacgtgccagatcatgacaaagctgcattgaggtcagctgattgagaatatcatgcctggtaagaccggtcaaaagacgaatcttctgataagactctctcaacgcttcatccatctgtttccggtcggtaatatctgaaatgaacccttcaaggaagagaatcgttccgtcatttccaaaaattccccttccccgctcccacacccacctggtctctccatttcgggtaataatcggatattcaccctcgaaataatcgttcatctgcaattttttctgccagatgtcccagatatcgtcgcgataatcagggtggatgatatcattgtaagaaagagtattatttccgatgaaatcttccggctcataccccgtcaattgcctgcagccgccactgataaacatcatcgtccagttcctgtcatttgcacaccggtacacaaaccctgggagattactgatcagagttttcatcatacgctcctgttcctgtccctgcatcaaggctcttgtaagttcctgtttcgtgtaccagacattcacaagaagagaagcaagaatcgcgattccacccagaatagcaagaattgtaagccagaaatgcctgactacctcttcaatggtaggtttcccataatcctcatagggaggcagatgtaaagctctgagaagttcatgaacagacgaatgatcctggggaatcgcccatcctgcactcctggcagccagtgcagccggatcatctgcatccatcatcagaagggcgacagataccgccttgctcaatgttagattcgtccctgaaaccgcagcaaaaggccattccgggtacatgcgggtggatatccggtatggataccatcgatattccatgctttgatcattgataacccggatttggcttagatcgactcgtccctcctttgccatccgctccagctgtgtactccgggcagttcctgcatctgcgtatccattgataactgcaaggactgcagcatcatgtgtcccggtaaagttcagttcagcaaaatcccgttcagggacaagacccttctcctgtatctccatgaatgcagcatgccagccgccaagtgacgtcggatcaaccgctgcaacccgttttcctttcagatcctcaatggtccggatatcagaattgtcagaccgggtaaatatcaccccgccgaagaccgggatcgggtcaggatcaccgggaacctgcaatgttgcaatccgctgggcaaggccatagtactcaagagcggtatatacagacggatttacaacgataaatgacacactcctgttctgaacggctggcattacctcctgaaaattgagagggatgatggtgaaatgatagggggcaagtttcccggagagatagtcagcagtcgggtcccactccatgtgagcaatctcctccccccggcttgcgagcactccaatcctgatttctccagagactggagagagaaaaggcagatgagtatccggaccgataccattgtcctgcaccggctgaatactactaaccgggagagcgggaagcggggcgatgaggagaaggacaaacagaagaactagaaaaaatatgaacccccctgaaaaatatcgcctctgcctcccggtcatcaccacaccatcttcccctgccctattcacctgagtatacctgaaccatcatattcggatagatggatattcacttctgacatgataaaacaggatcccggatctctttcttgagtaggataccatcaggcacccgatgccagccttatgacatcccttctttcaccacccatttccctgcagggacacggatctcaaaccgtgctccagatccccaagcaccggtctctgatatggtcatggcattgattgccagaatctccctgatgagaaataacccaaggccggtgtgcttcccatacccctgcctgaagatcttctccttctcatcatccggaataccagatccgtcatcttcatacacaaagatacagtctccatcatcaatccggtaggaaaaagcaatcctggtgacgttctccccatgccttatggaattttcaatcagcgtgaagattaccttttccagaatcggatctgcatacagatacagccctttcagatcaacctgacaggttatctgaccgattgaatacccctcgagcacatgagtaatcatccgttccgcatactgccacatgagcgatttattcctgatatcatcaaccagttttgtaaatgcgatctggctccggatagtggtggtacaggagaggcattttttaatatattgttgaatatccggatcaagatcatgatccgctagtaactcaagatatccaagaagagccgtcacctggtttaagatatcatgcctcgtgatcgaagagaggatggtaagtttccggttagcctgtaacagggcatccttgtcctctttccggtcggtgatatcacgaatagagaccaggtctgcatcctctccgttccattgaataagatgtcctgcagcctcgacagtccgtaccttccctgactgcgtgatgatagtgtactcattgataaccggatttccggtcctcttgatctctgcaaggtcagccaaactcatttcaagggattctggtgaaaggatgtccctgatattgagtggtgatgacagagaaccggggggtaattcgcatatggaaaaggctgccgggtttccatagaggacattcccgtcaaagtcaacgatgacaacaggatcatgaacattttctatgatgagacgctgctgcccctctatctcccttagaagccgttcagacgcctttttttcgctcatgtcaaggataatggagcataaatagtcgatactcccatcctgttttctgacaatcccggtggagataagaacatcaatgatggaaccatcttttctgatatagcgtttttcaaggtttccaggatcttttccggcaagaaccgattcaaatatcttcatctcttccacgagatcttcagcaggagttatatcagtccatcttatctgattgagctcttcggcagtgtacccgagcatagagcagagggcatcgttaaaataaagccatctgccatctggcgtggtaatcgcaattcctaccagagtggagttaaacactgcacgaaaacgttcctcactctccctgatatcctccattttctctgatatcagattatactgtgacctgagctcttcttcagtggcagagatctcctcgtatgctgcacccagttcttcattacttcggaggagtgcttcttctgattgttttctctggatgatattccagactccgttcataagaagagtcagctggcggatgtcctcatccccgtatggttcagttttattggcaacaccgatcagcattacaatccggttcccgtcaacaatagggacacccagatgacgggtcagactcacatgaccgggggggagtcctcttttcaagggatccggtgcagcataatcattggtaattaccggtctacgctgcctgaccggctcaccccagagtccggtttctgcaaccgggtagagctttttctggtctcttatctgacactcctccattgccacatttgaccaggcatgtatggtaaggacggcctcatcatcgcttaaaaatgccacatatccgatttcactgagcgtcagacggacagcctcttcgagagcgtaatgtgtgatatcgctcattgacttctctgtcatttgcgtcaggttcaggagggtttcaagcctagactcatcaagacgaagtttttcttcaacctgctttaacgcagtgatgtcagcatgggtcccgaccatccggaccggcgatccatcctcatcccattcgatgactcggccccgtgcctgtatccatttccatcccccctgttttgtccgcatccgaaactcgatggtatatccttcctgcttatttgagatgtgttcctggattctgttttttgtaatttcgatgtcgtcaggatggaggagtatctcccaggttttatatgtggatggatattcatccggttcatatcccagcatggtataccagtgcgggctgaaaaaagcgtcccccgttttgatattccagtcccatatcccttcgtttgacgcatcaagagttatccggtaccgcgactcggtatcttccagtaactcacgagcctttttcaatggagtgatatcccgaagtgactcaatcgccccgataacgttccctttcatatcatagagggggcaggcagtaatccagaagtagagttcttttccgttatggacccaggggcgggtgatttcagcagtgagggtgtgattttgcctgatgagggatggatacttctccatcatctccggatcattatcaagaacgaaatcgatgagcatcggccgcttcttctggtaaaaagggattgcataggcataatcaccttttccaatgatctccgatgcagatataccggaaagacgctccatggcccggttccaggcgatgacgacgtggctggtgtctatggcaaaggtggcatcaggcagaaaattgattatttcagattcccgttgttgcaggtccagaatctgcttttccgcccgacggtgagatgccgcatatcggaccttattggcaagttctgcaaactgtgcccttggatcccctcctttctgcagatagaaatcagctccgttattgagtgcctctattgcgacctcttccctgccccgtccggtgaacagaataaacggagtcttattgccatgtgaacgcaggtgttttaaaaacccaatcccatccattcccggcatctggtagtcggagatgatggtctcaaactcactgccctccatggctgaaagggcctcttttacgccggttgcgatagtaacacgaaaatcgccggtccgttccaggaaaatcttcccaagatccaggagatcaggttcatcatcgacatacaaaacagagatctgatcagtcatgtatcttctccatagcgccatttcccggtaggaacggtgatctcaaaccgtacaccatgctggtatgttccacactcacgaatggaaagaccggtgatggaaaggatttcacgagcaagaaagagaccgataccggtatgcttcccatatccatgctcaaagatcatctccttatcttccccgacaatgccaatcccgtcatcttcatacacaataatgcaatctccattgcttcggtctgccctgacacgaatttgtgtgacctgctctccatgacgaattgaattttcaagcagcgtggtaaagaccttccgaatgatgggatctgttaatatctcaagggtttgtggtatctcattataaaatgtaatacccgggcattctacctcttcacaagccgattccacaatcggttgtatcgccagccatcctgtcccatatattccgaagttttcatattcacgggtaaaactgattatcttttctatttgttcaccagcgatccgggcattctccacatactcatggatcttttcaggatcagaagactggagtgccaggttgtgaaacatatcgacagctgatattttattatagatatcatgcctggtgagactggttaaaagacggagtttcacgtttgactgacgaagagcctcctcattgtaccgttcttctgtaatatcacggataattgccaggacctcacggggtgctgatctgataatcctcgcctcaaaccagagctttttattctgaatatcaaggaaatattcaaagaactgcatctttccggtcctgagcgttttctgaatggctgaaagacccctggttgcaacgggttcggggagaagatcatgcagtgattttccgatcagttcctcttcaggagagattaaaagagcaggatcattcacatgacaggtcagatataccccgttctcatctaatgtaaacaggatatccggaatcgcattcacaatggcacggaatcgttcttcattctgtttgagtactacttcagcctctttttgcctggtgacatcccgtgcagaccctaccgttccaatcatttcgccctttgtatttaagaacggggctttgtgcacatccaggtagaggaactttcccttgacattgccgtactcatcaaactgcctgggttctcctgcatccatggtaatctgatccgtatcacggcagatatctccaaaggtgtgccattcagggttttcaggatgttctctcttttcacgttcagcaaagaaaagatcagtcttcccaatcggttcagagggatcacgggcattcaaaaggtcttcgcagagggccttgtttgcaaataaatacttcttctccaggtcttttgcccatatcatatcaggaaccgtatcacacatcatccgtatcatggatgagaaggaatgataccgctcttcccgctctgttaaggctttttgaacctgccaggtctgtgtgatatcatcgcaccccccatacagcctgattactccggccggactctcactctgttcacatctggtcttgcaggatatccggatccggtcaccatttttatgcctgatccagagttcacaggttgccgactgaccaggaacaagacccgttacatactgatcaaatacggggagatcctcatctataacaattgccctccagcattgcttttctttgagttcatcgatggtgtacccggttattggttctactgccccggccatccagtcaatgtgaaacatcccgtcaggataccggacacaggagaatgcaaagtctgaggtaagtgatgagatctgccggtatctctcctcattatgaagtaatatctcttcagcatgcttccttcctgatatgtcaactgccatctccagtctgaccagtcgtccattgatccaggggattgctcgtgcatggcattcataccaccgaccatctatgggatttttccgttcccatacatgtgtcccgagcgggccttttgaatcggtgagttgccggtttgtacagaatggacagggagaagtctgacctttttgtaatacctgatagcagggtttgcctaccatatctccatacagttctctggctttctggttcccatatatcagttcatggctctctaaatcgattatgtatataagaatgtcaagggtatctaataccagaatcagttcttcaatgcctttgtcatggagaccaggtacagcagagacaaagggtgctttctcaggggatgtgatagcaggacaactctcatccatatggatattatgatgtttctgaagatactgaagaatggactcagattcattccaccgccggtccagctgggtgaccatggaatctatctggctgacctgctgcactatcatctccctgatctgtttctccggaatgagttctgcatacccggtaataacagcaagggggtttctgatcccgtcgttgagtaccgcctgctgggcaaaattgacctttatctgttttattgcagcatccttctcctcttcaagacggagtttttctgtgatatcaagaccctgggcaatggttgcaaccaatggtcccccggcggtcgagtatatgggtgatgagttccagagtatatattttacacttccatcacggtgccggaccgggatatcaaccatatcccatcgctctccattaaaagcactcttcataaggcaggcccatcgttcctgatcctgttgatggaagataacagagaggtccttaccgatcagatcatgagcagggcatccggtgagaatctcacatgcacgattcaccccggttatatgtaattcagggtcccaaacgataatcggcccgcttgcattggttatcaggttttcaagatactcatttgtctttctcaggtcatcctcaaccgatgcacgggctattgcagaccctatggaattggcgagggtgagcagcgtctctttctctcctttattccattcatattctgttctgcagttatcaaatccgataaatccccagaatttccggtccacaataatgggtacaaggaggatggagatgatcccctgggctgccagtatctcccgttcactctccggatgattttttaccaggcctgataccatctttcctctatgcagcagatcaaatgagtagggggcaacgatctgaaatggcatgttctgcagatccgggttatcgagctgcgaatcaacccccttgttcgtccattcaaaccgctgacttaccaggagttcatgggtttttggatcggtatgagcctggaagatatagatccggtcctgatttgtggctggaccgatgatgtcaagcacctgctgaattgcctggtttacctctttctccatgagaagaatcctggtgcattccgcaatggcagcgagtaaccgatcctttcggacatgtgcattctccaattttctcctggcaactgcccctgcgattcgatcccgcaatgcttcaaattgtgtctttggatcttctcctttctgcaggtaatagtcggcaccgccttcaagagcctgtatgacaacatcttcccgaccccgtccggtaaagacaataaacggggtgaagggatcacatctgcgaaatatggagagaaactgcagggcattcatatcaggcatctcataatctgctataatcgcatcgtatgatttttgctgcagtctgatcaatgcctctgtggctgaaagggatgtatcgacagcatattctcccgtatcctcaagatagagcctacaggcctccagcagggccgggtcatcatcgacaaggagtattgagatcatagtctgccggatttatgagagagtggggtatctgcatacacagacgtatatatatggacgttttttgtctctgcaggggatgtcccttaaaactccaatgtatcctatgaataaaaatattgttatttattccttgtcctaaaccatgaccgaagaggagtagaaaagtcaatgataggagggaaatgggcattttcttaccatgtgaggcagcacgaaggagagggatttgtcaaatcattcttcatagggtaattgtgacacagacagatatctatccagattcactctttttgaatcgtttggcatatatctcctcgatgaaatccgggagtggttctttccagggttcctgtttattgggtgcatatgaaccaaatttcttcgggttcagaccaagttcttttgccatccggatatgctcatcggtgagtttataccgcttttttgcgtcagtccacgcttcatcctttgaggagggggttttattttttgtcatgctttcaccataccgggatatatgaattcagtcagttccagatacatcatcttttatcaggaataaattgagcgataatatctaatcatatatcatgcattccaggaatcagatccggaattcttatagctccggaaaaaatgaatgcaggttttggttttttacgtcttcaaccgtttcatggattcatctatttgggtcgcaatttgcgatagttcggtcatgatggatgatatctggtttaatgcaaccgatgactcctctgatgcaactgcagaggctgatgcttcatctgacgtatcgtctgccagggttttcattcctgaaatgcgtgattctatcatctgaacggcatttctttcttcttccgaaagagctgcaacttcagcgatattatctgatatctcctgtatctgttcggctatggtatggaagaaccggattgtctcgttgatcgcctcagaccccctggtcacttcatcggttgctttctgcatcgctgctccggctttttctgactgggtctgcagttcctcaatgatccgggagatattatctgctgaccgttgtgagtcctgtgccagggtctttacttcgttcgcaaccacggcaaaaccaagtccggcatctccggcccgggcagcctcgattgatgcatttagggcaagaaggttggtctggtctgcaatggaactgatgatctcaatgatctttccaatctcctctgcctgagtcttgaactcttcaatgatgacgccggcgtcgtgcaccgctccgttaatcgcctgaatgccatcttctgcaatatttgcctggaccagtcctttccctgatatgtcattgacatcctggcttaaccggctgacatcatctaccttggaggcaaccatggttaccgatgaggtgaattcgactcccgaattctttcggaatctaaaaattttcacgatttttattggcctgtttatggagaaccacattccaggtcataatgggataaattcatcaaatttttttccatgaatgagtttatcagtttctctgatgagtttttcctcctcaattgagatcgttttatcttcaaggatttctatgatatgatctagtttatgttcaactctgacgagaatgtccttgtcagaaaaattattagggtaaacatcggcagacatgattttcatctcttatctgttctatatgtctattaatttttcaaaataacagtttttcctttgagtaaatgtgggtgttgcaatgaattgataaatacaattattattgggcattatcaggattcggtatagtatatgattgaatgcatctttcgaaaatgagaacccaataataaaactattgaatctctggaatcatgacataccgattatgttttttaaccccgtcgaattcgacgggtttagaatgttgtgaaataaagatggggatcaatttcggatatttgtcaagaaaccctatagataaattgtcaaatccaaaagcccggaagagactgaggggatctgacgtgctcgggtttcacccctaccgtgtatgtggtgatgtggatattagccatatacacgctctattttgtcttgaaaagcatgagcaatttgattcttttttatatttgtgattttcgggtgtgtgccaggatttcctcatcatcaaatcctgcatttcatgaataatcattgccagtgttaggatcttgacggtattagatatgatgagtattttcattctgcccatactgctcacattgttcagatgaacatattcttatgatctcataccaacatgaggagacagaatgatgaacttaattgcaggaacaggtgttgaacctgagcacataacagagaaaacagaaacagacttctgtatgacccatgagacataacatcgaaatggtcttatcatgaaatcgttctatgtttatatactgcaccagatatcatgacacacacccagcttcttcatactatccttcatgaaccacgaccgctatcagagagccagcaatcagcaataacgacacaatcaccgcatgtccggattattgccggtgcaggggccgggaagaccgaaacactgacgagaaagattgtttctctgctattggttgagcatgtggagcctgcctctattgttgcgtttacgttcaccgagaaagccgcagcgaatatgaagagcagaatatataagcgtgtcaaggagctgggggaggatgcgttatgtgcccggcttggtgagatgtatgtcgggaccattcacggattctgctttcaccttcttgaggatcagttcgggtatgggtcctggggagttctggatgagaatcaggagatggcctacctgatgagggtcggctgggaactgaatctgacaggcagttccaattataccgaaaaatgtcaggatttcaagaggagtgtgggcgttttctataatgagatgctctcacgggatgaggtgaagaagcgttctccagatttttattattcccttaccaaatatgaagcgtgtcttgatgaacaccaccggctgacctttgaccggatgattgctctgacggtggagaatctccggaagcgtcctgaagtcggggattttattcagtatcttatagtggatgagtaccaggatattaaccgggcacaacaggagctgattgagattcttggccgggggagtaaaattttcgtcgttggggatccacggcagacgatttaccagtggcggggatctgatgagcactgttttgaggagtttgctgagtattaccagcagtctgagacgatatccatcccggagaaccgccggagtgtgcagacgattgtgcaggcggcgaattatttttctgagacgtttgagaagtgccggtattctccgatggtgtattcccggtccgaacagggaaaggctcatcttgtggagttttcagacaaacggagtgaggccgtctttattgctgatgagatctcacggctggttgagagtggcaggtgcaggtacggtgatatagggattcttctcaggagtgtgaatacgagtggtgagccgttcattgacgtgttccgggagaagcatattcccttcatggtcgggggaaaggtgggcctattccgtagagcggagattgcggctctagcaaagattgtggtctgggcttctccgaacgggtttttccagaagtcacgatgggactggaagaataagattgagggggaggacctgctcacgttcgggtcacaggaatgggcggatgcaattccgggtctttgtacggttgatgagattcttccccggctgaatgagtggaaacggcagcttcatgggaaagggtttgatcatgttgccggtatgtaccaggaactcctctccattctcgggtttttacagctggatccggataacccggaacatgcggtcatcatggcaaatctgggcaggttcggggatatcttaagcgatgtggaaactgcacagaaactcgggggtcaccggatctcatggccgactctgttaagacggtaacgtattttctaaaccattacgcgaacggagcatatgatgagcagatggatgatgatctggccggtctgaatgcggtgaatctgatgaccatgcatcagtctaaagggctggaatggccggttgtattcatccctgctctggtgaacggaaggtttccctcagcaaaaaccggaagagagcagagatggcttcttccccgtgatatgttcaatgtgtcaaggtatgaaggtgacgtggaaggggaacgaaagctgatgtatgttgctatgacgagggcaaaggagctgcttgtcctgtcatattttaccacattaaacgggaggaagaagggtgtcagcgaatttatcgaggatctggccgactgtccggatattgaggttctttctccctttacacatctacctgatctttcattgtcacagcgtggtgaggatgatgagatccagacgtttgccgccggcgagctgattcactatagtaaatgcccgtaccggtacagaattaataccatatggggatttcagccgggtatcaacccgtatcttgggtatggaaatgctctccatcattgtatgcgggaagctgccgaactgatgaaggaagggtatgatccggtcacggcggttgcaacatcggttgaagagaactttttcatgccatttgccgatcccggacgtgcagaaggtatgcgggatgtggtgatggagaagctgattcattttgccgaagccaggaaggatgatatgctccggattcgtgaggtggagacacggattgagtatcccctgatgcaggcaacggttgctgggaaggtagatgtgattctgcatgataatgaagggatagagatccgggattacaagacgtctgatacggtggttaccgagaatgatgcatcgatgcagataaggctctatgcccgtggacttactgcaattggagagcaggtgtgttcaggttcgattgcctttcttgaggatgcaacggtggttccggtaccggtgagtgaagagatgctgacaaaggcagagcacttagctgagaaaataattacaggaattgtgaaccgggagttttcagcctgccccggggatcagtgtaaggcatgtgattatgtgaaaatctgccggtttgtgtgatacgggtgttaagcgatggggaagattacggttcttgataaagaaataacagtatcagttctccatgaggaggattatatctgcataactgatattgcgaaatacaaagatgcagagcgtacagattatattattcaaaattggttaagaagcagaaataccattgagttcatcggcatatgggaacatttaaataacccaaattttaaccccatcgaattcgatgggtttagtatgttagggggtagaagggcggttccggattactccaacgatatacctacccaacgaaataacaaagatgccggcaatacagatactataacaacaaaatatcctggagggatagtatggctacaacaatggacgtagtatttgatggttctgtgcttcggccgattgatgaaataaaacttgttccgggcaaaaaatacacaataattattaattctgatgagatttacgagataaatcctgaactggatcctgcatttaatatcgcctcattagctgtggatacagggattcctgatcttgcacatgaacatgatcactatctctatggaactgacaaaagggcgaagaatgaatgaacctacatcagagatattcgttgatattgcatgttggtttgcgttattaaaccaaaaggattcacttcatataataaccaacatactctatcaggatttgatgaaaaaagggtcagtatttgttactacgtcctcaattattgaggaaacctccaatgctttatccaatccaaaattcagatcgtctttgataactttttatcacaatatttgtcgttctccaagagttcccattttgcatgttgatcctgaattatgggaaaaaggatggaggcttttttataagcgagatgataagaattggagttttactgattgtgtgtcatttgtagtcatgaatgaaagaagtattaaaaatgcccttaccagtgataaacactttattcaggctggtttttctgcaatgctgcagaattgatcaggctttccggatcgtttccggatcactccaaaaaaggagaaagagtaaactctatgaatcaagattatttctcgaattatcacatgcattttaaaatttcaaaattaccagaatacaggctttccggatcgataccggatcatgaccgctgtatgagctatccaaaacgaagaagtacgatgtattgaggagacgatatgacgaaaccgatgaaagagaacgatgaattattggtgcgggaagtaaaatcagcatatgatgaagagttacaggtaaaagagaaggaggatatcgagaatctccagcgtctcttacgtcagctcttccagctccagaccgatgatcagctgaactacggtatctaccggatcatgaatgagaagcgggctgaggttgagaagttcataacaaagacccttccggaccaggtcagggaagcctgcacagatctgaccccggagattgcccgtcagcatcgttcgttcatcttctcacatattcattcgttcttctcccggtactacgagaagggtgatttcatgcccccatgtatctaatcctgtaattattcaggtatatttacctcaacccgacactcagcagcaaattgtggttttaaatacttaataacctagcgatcactaaagggggttttaggtattatcaggaataaaattcaagttagacaaaaaatatttagatttaatgtgttttagaggctgttacataaccaaaatgtcatttccgcaagaaggataatttccattcgagtgaaacctaaaatcggcgataaaaaatctggttttttcctcattgtaccagcggtttaaagttatgcaacaacctctacattgaatcttattttttctggccttaagattgtgttcaaccactaatcccattctacatcttccagaataatatgaattgaaaccaggatctcaatcaacagtaagaaaaattcagggatacatctctgaaaattctggagcaataaaggccccatgaactgctgccaaataaagtccgctctgtgttattgttatccggtgatatcttccgactttctttttagtaacatatccagatgcaatgagaggttcgagagcacttttattaaggcgggtatgatacctcctctgaatcattctcatctcatccttgtgtttctccctgaatggaatgtcatatccgggttctcctgactggatgagatgatccacgatctcccaggtaaagagcccttccttttttcctgctagaagagatagtacagtgactttcattttatccgggagtgccaatggtattttttcaaggttccatattctctgttgcttacagattgagagaccatggcattctacatcatgggctgaatctgcatatttatctgcacggacataatatagagaaacatcatgggccattgctgcaagggtagtagcaaaggccgttattctaccacatgcagacatattaacttttataactgaattctgctctttttcttgattaataatagatgcaacctctctcattacttcaagagtattgaacatatcgatctgttttgtaatgacctgaattcccttctccgtgaggatatcggaaacacgactctcataatgtctttcccgtgcagtcatctgaatctcctccggagtattgtatttttccatctgcttcatggtaaggagatacactcgaacggctttttctgaatcaaatggtcgtatggcacgatcaatctcatacccaagtggaataatatgaacagaatgaggatgattactctctgccataggtgttttattttatattgatacaaaaatgtctttcggtttatccacagattgatgattgcagataaatccccgtacttacggggaacgaacatgtaaaaaattctaacacctaataatcagatgggtcatccctgtatcacaaggattggcaattattagtttttttgacttgataatcttttgttgcaccagatgaatgttatacgagaatggtctcgatgtttccaaggttttaataaaacgatatgcttacagtttggcacttaagcgttaatataaaacaaaataggagaattttcgtatttgaatagagaacgaagggaataaaaaaaagatggtagtaaagatacatggccaccaggtgaaccacgatatccagacacaatcttcttaattcccttttcagggatcctttttactcaggtttcatactatccccacccggctgagatcgtggattatcccaaacacgggcaacaattatttgttaagaaaccctgtagataaattgtcaaatccggaagcccggaagagactaaggggatctgacgtgctcgggtttcacccactttcgtgtatgcggtgatgtggatattaaccgcatacacatcctgattacttttgaaaagcatttattatctgattttgtttttccttttgtgaaagtcggatgtatgcccgaactttttatttgcttatcatttacttattcaagtgttctattgaaactatctggaacacgcatacttgtagacggttcccattcatcccgttgcacaccaggaactcatatgtataaccagtatatgtcagatggggttcggttcatctccatccacacggggaactcgccacatagcagccccacactctcttttctcacggttcatccccatacacacggggaactctttacctgccggaagaaaggcgacaacctattcagttcatccccatacacacggggaactcgctccttctcaagttccggggttgcagtcagtccgggaggcagaacgtttgtcttgatgttctgccaggcgtcttcctgtgcttgtgcttccgcctgtttcttctcgtcttcgaatgcctgaacttttgtgtttaattctgcgatggcggtatccttttcagcaatctgaccggtcagggtttcgacctgagcgttcagaagagtgacctgtttgttgagttcttctgtcatgttcgaattgctcgcattgaggataggggccggtccgttagccggagtcagccctttgatagcctccattagtcgggtaaaatgcccttttagttcttcagaatccatagtctgactccgtgcgttcaggaacgtggcccccccgtcctgcggttgaagcccgtcctttgatttcttgaaaataaggatgtggtcaggttttactttcccgaccagtcgtccatcaccatcgacgtctgcgataaaaccggaagagaactggagttctccgttgttgtgtaaagtcctgacttcagaatcggtgaactggaacgacccggtgaaccgtgcggttccgttctgaacgatttcggctccggtgaacgatccgacaacccgcccgtctgattctttcagggctttcttcaggtcctgtgtcagcaatgtcttcggatgcctggttccaaagatgagcggggtaccgttccataatgactcagtcccggtgaagttcccggaaccaaagaagagtttccggctcaccccgtcctggtttgtatgtgaccgccaggtatccagggtgtgcaggattacgtcgtggccggactggtccggtgcggcgttggcgtagagctgatactgctctgccgaagacataggagcatattatgctcagggtatattatgaaatatggaaaaaacagggtacgagcatagtgaaaggggatgatagtcaggggttgcgcataatgtgagagggtttcattgaggtaattctaccttttattagaaaatggacagttcaaagaacaagcgataataagcaggcaatagaaacataagaattgtcatggtatagccgccgtggaaagttgctacccatgacaggacattaaccatggtatatcgatttcaaatcgtaaatacctttctcgtgtgggcttgtacccgctcgggactggtagaaaagagtctgttagttgctgatatcatccttattggtcaacacgttggcctttggtgatatccgcttaaccctcttttttaccatcttcttctcccaggggttcaaactggaggttatgattaaagaggtcgaacgctctttttcagtttactcacgtctaatccaaaggtggttttcatgaactcttctgcccattcacgatccttcattttttcttcatgcgtgcgagtatcttttattccagtgataattccatcatcacactctttccaccgtttgaatgtctcttcttgggtcatcttattactctttttagaagtatcatacgaactttttctaatggggtcactcgctcaaccccgtagtcagtgtgcttatattcgaatctatctgcattaaagatatctccaaccacatactcttctccccgtggcattaagtactcatattctccatctccaagtgataaggcctttgttccaggaggggtttgaaacatgaatacattacagaatccgctctcatcacgttctttcgctgcaaacccataagcagtactcaaatctaatgacgaggatctgtatgctggttcgtgatatgctccatcttttatgatatcttttgctttttctattccaagaccaaagaaatgattgttgcgctctgtcgtgatagaatcgggtttattaaaggaggaatctatgttcgcaatatgcaagtacacggttcatccccatacacacggggaactctggatgtcagaaggattggcgtttcgcgatcgcggttcatccccatacacacggggaactcgaaatgggattgaaacaaacgaaggaagtagacggttcatccccatacacacggggaactcataaaaaaaatctaatcctccaacacatcatgcggttcatccccatacacacggggaactcgtgtttgcagcaccttacgttccccgttttgacggttcatccccatacacacggggaactcctaaaacaaaaattagttaagttttaagcgctcggttcatccccatacacacggggaactcatcgaaatgatgaccttctcttcttcggtcatcggttcatccccatacacacggggaactcgtcatgaagtgtttctctgaatgcaagatatgcggttcatccccatacacacggggaactctttggattcatgcgggaaaatgtgtgatgcttcggttcatccccatacacacggggaactcaacttgctccccactctcatcgatattacacacggttcatccccatacacacggggaactctgaggatggggcttcctgcttcatagagacaacggttcatccccatacacacggggaactcggcatcaggttatgaacctgattaatgacatacggttcatccccatacacacggggaactcgaaactggttgagattatgattctgccgattccggttcatccccatacacacggggaactcgtatatcgcgttctatccctcaattcttggcgcggttcatccccatacacacggggaactctcaagtccgatgtcagataagatggtcgcatccggttcatccccatacacacggggaactctcccgaaagaatgccctcatctaatttcgttccggttcatccccatacacacggggaactctaccgctgatagtcaacactccacgagtttcacggttcatccccatacacacggggaactccaattctttcgcatcaagcatggattcgagttcggttcatccccatacacacggggaactcgtgttatcttccttctgattgactcggaatttcggttcatccccatacacacggggaactcgggtacttccgggccatgaggggaaccatcaccggttcatccccatacacacggggaactcccaaccgtcgccaatttcagttttgcctgtttcggttcatccccatacacacggggaactcattatatcaatagatttgtatttttctttgttcggttcatccccatacacacggggaactccaatatcctctgatataattgttttacgtgcccggttcatccccatacacacggggaactcaagaccgtctgaagtccacataaggatttgtccggttcatccccatacacacggggaactcgttttaatggcgcccttatcggtattctatcccggttcatccccatacacacggggaactcatgatatctgtcacggctcatactaccagtgccggttcatccccatacacacggggaactcttcatctaaccattcactgatcaaatcatacaccggttcatccccatacacacggggaactctttcaggatttcctcatagaattccaggtctacggttcatccccatacacacggggaactcgtacacatttggtgaacatttgaatactctctccggttcatccccatacacacggggaactctcaagagtctgttctaatacagtctcttgagccggttcatccccatacacacggggaactcacaggtatgacatacagtattgagtgttgcaacggttcatccccatacacacggggaactcgccccaccccccccatactctgcgtaggtactcggttcatccccatacacacggggaactcatacatcatttcgcggactgccttgcactggtcggttcatccccatacacacggggaactcgtgaaataagcgggcttgacgggaaaattatccggttcatccccatacacacggggaactcggaaacggcaataacatcacgttaggaggtgacggttcatccccatacacacggggaactcatcctcatgcggccttccctcttccagttcttcggttcatccccatacacacggggaactctccaggcagtttgatttgaattctttttctgacggttcatccccatacacacggggaactctcaggagtgcctccaagtgcttcaatcgcctgcggttcatccccatacacacggggaactctatttgtctcatgggcctaatacctctacccctggttcatccccatacacacggggaactctccgcctttccctgcctactcattgcagagtccggttcatccccatacacacggggaactctccttgggttttctgatggttctatcaggattcggttcatccccatacacacggggaactctatgcaaaaggagcgataagcacgtctacgtacggttcatccccatacacacggggaactcccgcattcgcaggcaatatcacaggttgcacacggttcatccccatacacacggggaactcgcctgccctatgttccagagccgatcttcccatggttcatccccatacacacggggaactcgattcaaatttgtattatttacccgatttttatggttcatccccatacacacggggaactcatccctctatcacaaccaaacatcaggtaatccggttcatccccatacacacggggaactccaagtctcctgcagactatataaagatatacgcggttcatccccatacacacggggaactcatgttgcgttccctgatgcatccagcgtgcatcggttcatccccatacacacggggaactcattccatcagatgtatctgtcatatattgcctcggttcatccccatacacacggggaactctaataactccaactgttttaatattgcttctacggttcatccccatacacacggggaactctaataactccaactgttttaatattgcttctacggttcatccccatacacacggggaactctttgatccgctccagtgagaaaccatagaactcggttcatccccatacacacggggaactctttgatccgctccagtgagaaaccatagaactcggttcatccccatacacacggggaactcataagctgaacaaacaatgtcaagattcattgcggttcatccccatacacacggggaactcaattgcaccagcacagtattttgaactcatttcggttcatccccatacacacggggaactcggttggattaaaatctcctgttgtttatctctcggttcatccccatacacacggggaactctcaaatttctttaagtgttctactccggttatcggttcatccccatacacacggggaactcgccgttatcccaagttccattcgcttcataatcggttcatccccatacacacggggaactcgttttgatattgaactatcagaggatgggttacggttcatccccatacacacggggaactctcatttaccgtaaagacgattggtgcatttaacggttcatccccatacacacggggaactcataagcgcacggcagaacggaagcgcgaagggcggttcatccccatacacacggggaactctttattcgcggcgattactatttcagatattacggttcatccccatacacacggggaactcgggtgcatcccgtgttgaattgaatacataaacggttcatccccatacacacggggaactcttggttggtgaacttggtgctattgtcggatacggttcatccccatacacacggggaactcttggagaatgggtgctactctgtttataggggcggttcatccccatacacacggggaactcgaattcttcggctctctgttttgctgcgtttgcggttcatccccatacacacggggaactccgattatgtcctgtgggactgtttttattacatggttcatccccatacacacggggaactcgcaggagttgtgttcattggctgtccattaggcggttcatccccatacacacggggaactcatcaaccctatattcgacattggagcacgtaacggttcatccccatacacacggggaactcaggagatgtatcgaacaaagagcattggattgcggttcatccccatacacacggggaactcattagtggaagacgtccgggcctttgccgaagcggttcatccccatacacacggggaactctgcaacccgatgataatcattcactacctttccggttcatccccatacacacggggaactcgtggctacaatcgtgtgatctgctcgcacattcggttcatccccatacacacggggaactcgtagtgatcactcatcatcatcaccataagcacggttcatccccatacacacggggaactcaacacagaaccaaccatccggaagtgctggtacggttcatccccatacacacggggaactcttactgccatttctttcatcagggttggtgtgcggttcatccccatacacacggggaactccaggttcgtgatcttctgaccgaccggcattccggttcatccccatacacacggggaactcccgcatcaacccattcacacgtttcggcatgtcggttcatccccatacacacggggaactccagggacatctcaagaagggtaatcgtggtgtcggttcatccccatacacacggggaactctacacgtttgtggatgatgcagttatccggatcggttcatccccatacacacggggaactctcttccctttttctcctcttggaggaaacgcccttcctccggatgcccatatcaggtgaacattactttttcttattttcctccggcataaatgctactaatggatggccatcagcatcaatcggaatccggcggttatgacccacggtctcaaatttaaaccctgcttctgtcggtgtgtgccacatcatcacggcatttccttttccaatacccgaacatacctgactccagatcatatctctgactcgcacagaatatgaacccacatacactccagaacggacctccaagagccaaactgcaagcctccctcgtaatgacggcgggactccttctgttaccacaacaatcatgccggctcatccctcctcatcaacaggaatcgccggtggaacaacccagtcaggaggagcaggcgcagaaatgccaccagctgtcagcacctcctcaatcgttggaataatcctcttgaggagttgtgtttcccggaataaatcgcggcaggcatacctgacctcacgctcaggctccctgggatttaatgcagccgttttaaacgctgcagggacaaccgtttcaaatttgaaaaggtctgcaatatcatacacaaaagaaagcggctttcccgtatgtaagaacccgatagaaggagaataccctgcagcaagaacagcagcctcacaaatcccatataaactggcggttgctgcactaagacatctattcggaagatcagcactcccccaggaatgaggatcatatcgcctgccattccagatgacaccagtatctcttgcaatcttacgatacccttccctgacacgaaccccttcaagtccccgtaactgttcaacagaatatgcatcagaaaaatcctctccaaaccggagagagaacatcttcttcacaacctttagccgtaatacctcatcaagagcaagacgtgcctggtacaaaagacgatctgatcgggcacccccgggatgaccaacagaatagagacgaacaccaccctcacctacaaaaacaagcagacaaccaactttcgatgcaagagagaccgctgcatgggaaacccgtgacccaggttccagcatcagcgatgcaaggccaccgacaggaatctgcatcctgatcccattcgtatcaaccagaacaaacgcaccatcaataacatccaattctcccctaccaagaaataccaccgaagaacgctcttttatcggaatcggctttatatcggggagagtaggagtcataatgctgcccgtttcaccatcatgagcccacagccaaacccttttgccggcccaagcccattacagatcatctggagaaacaagtcaggatcagtaacccgaagaacaccatcgcaatccacaacactaatggatatggtattttttttcctgccctgggaaaactgcatctttcggtatccccctgcaataactctatcctcatataaggaaaaacctcctttttcactacgctgacgaagccagcggacagactcctgctgaaccagatcactcattgaaaaagatgaatttgcctcattaagtcttctttttgcatccatgataacatcatgacggtgacgaatccgttttctatctggatcaggctcagtctttgtcacaacaggatttacacggattcgaaaattcagcagatcatctttctggagaaccggatgaaatggctttgaaagaatattccacacatttccttcgtaaaccggcttcctggctgagagcaaataaactacaggatcccttccggttaactccgcacgatataaaaaatctctctttctatcaggatggtctgcaaaaagatcccagatcacttcatgcacctgatacggccctgtcacaagatctcgaaaccgacctgaaattgcagcttctctatccagtgtcattttagaaaaaaacattatcacacctcggaaacagaaatacgagcataatattcattacggtcagaaaactgccacctcgaccgggataatatattatcacgcctcttcatcaccatcaccgggtcatcaaatccgatatcaataccatcctcaaaatagagagacacccgatccggtactctgaaaccattgaggagatcaaacccctcgatatgctgaaccagggctgacttcaatgaatcagcctgtatgacccgtgcatgaacaggaagggcaggagggcaggattttctccccagatacaaacaaaaaacaggatttcgaaacgatgctgcaatctcctcaagagagaactgagctgactcagcatcacggatccatacacaggcaacagaaacatgatcacacaggtactccctacgagaaagaattgtttccgaatccccaagattcatctcatccctcctggtcatcacatgattcattttcttcaaagaagatgagtggactgactgaatggtatgaaaatcctgaatcattatgccaggttgcaggaccatcaccgagaacccatatccggcctggagtctgttctgggcttcttcatcatcccgacgaataccaagggctgcagcaaccattccaagaaccgctgaccgggacggtcttgaccatgaagaccgcatttcacccactgcaatccccccatacccggccatcggtccgtagagattaatgagacaaaacttcgtcatgactctaacacaaatgagataatatcagtcagactccctgttccatcaataacattcatggatctggacgattgcttaaaagaagtcccatatgcattatccatcctatcccgaagaccctcaagatttttcacagcatctccgtagatatccttccccgaaacgggtttgaaaaaggcggctgcaagagaacgcggctgctctgtacccttttcaacaagcagatatgacgcatatgaccgtgatgcaaaactattctgtttccctgatgggctaaccatggaagcggcacgaataagagcctcaattgcccggttcgaaagttcattatcaccttgaagattttctttcaataaatcacggttaatacagatataggtataaaaaagacctgcaccaaactctgcttcaccaatatgccctgctccggcagtatcatcaagctgattgagatcatcaactgctgtaaaatagtcatcttcaaccggcgtgtcatgcaccgttatagcatgggaaacctgaactgctgcctcagtattatatgctgcattatctgcaagcatacgtccgaataaagcaatatcaacagctttatgatcggatcgaagtcgaatacaatcatcatctgatactttttcaccaccagaaatccgaccaagaagatcatcaattccagcaatctcttccggactataatgaaccatctgcttatgggagagaggatttttattactcttttcatctgttttttcagatttcttatctgaatccttctcttttcctccctcgatcttcccaaaatgagaacttatctttaccgcccactcatgagctttcttctcatcttttatcctctccctcgtcactccagactcttttccctcaaggatatcggataataacctcccctccaccagagcttttttaattttcacccccatatccctggttcggataccaatagcccctttaagtgcatctgaaaatgcctctgatgtccgccatgatcttttcagactttgcgacgatacacgaatacgctgtgttcctcccaccgtggcagttttgggtctcccaagatcgtcacgattcagattggatggcggatacgatgcaagcatatggatctggataaattcactcattcttttttcctccttgatttccttcagactgtaatactttttcaaaatactcaaatgtcatctcttttctggatttttcattccagaagtacaattttctgaccacatcatcaatattcaccgtcccattcagcatccgtatgatccttgtcacaggaagaaagagatcgggatatgattcacaccgaataagttttcgaaatctcgcttcactaacagagggggtctgacctattctgctctcacccatctgctgagcaaaagtaacaccagaaatgtcttctttcacatgagcaagacttactgcaatcaaagccaaagcctctcttctcaccattccatgcggtaaaagactctgataaagcctgtgaaaagccggacaaaaaaacacttctgtaagatcatgacacctccgtaactcagcactatctccacggctctcaatcaatcccttccaccaggagtgaaatttctccctgacaggatctgattcaatagatagatatacatcagtcatagctttttctcctccattgagtccttcatgagaagacccagtaatgaaataacttttttcgtgttctctccggtaaattttttaaatttgattcgggcatcgataacactcttaggatcattcagatcgctgatgagtgaaacctgggtataataatcaaataacaaaacagaatgaccaactaacatacgataccattcacgctttatttgatctatctgctccacatttcccaaagagaaaaaaagtctatcaagtgtagcatagaacaattcctcagtctcattccaaaatcgggatcttaaatcaacaggttcttttcctttattaccatgtcctgaaattgcgtcctttattgagccggcaagagactgcaacacatattctgctgtaaatataagatttgaaacaatattttcaaataattctctctttttctcatcatccagcaggtagattggcatccggctttcataccagcatctggcttttgcattatccatatcatatccaaatgaccataacctaacctttttaaatgatttccgctttaaacgaataatattattctgaaaatttgttacagttctggaaaccttgatattccttgacgaatccggaataatcagacccataaaatttcgatacgtaatacccccgggttgaagatgaattgggcgataaacttctttatccaggtaataaggagtaagtgtgtgattgtcccaggtttcgtcataatcaactccatgaggtttcgtatgatatgtcaacacggttgctgaagatgcaagaccacatacatcacaggcccctaccggcttgtcctcaaaatcaagtaatatccgtcttcccatcccccagaacatctgtaaaggattaacatcgatcacgccagttttttcctttttatcactcaggcgaatcttcccaaaccagggaaagatcatatccatactctttttttgttttgctatcgcatctccaaaaaattttattgaaggaataatattcagccataccgtctcccacaatgtctcccccaagattacagacgttaatggccccccacctcgtaaacctgttttatgcccagctccaccacctggtccattaacctgaagagtaaataaagccatagcagcacaagagggacacatctgctttacagtatcgcgtttaacaaaaaaatcagtatttttcttgaccgtattctccccaggcatttcaataagaagaccgtcaactgaatttttcttctcatcaccaatactgatatcttgcataaatctggggcctttaccatccagagagaaggcatcctgaatctgcttgaagtgtcccttcaatacatctgaaggaattacattatctaaccggtcagtccattctttatccgattcaggaggacagacagtctgaattaatcctatcagaaactgaataagagctccattaaaatctggacgtgaagcattaagttctatcaccggatttgtatcataatccgaggtaatctgatgcggagcgataagaccggaatcaccgttttttctcacaaccggaatccaggcatcatgtaatagatggatcatatctgaacctcataaaataataagtctgattattatgttaatcactaaccaccataaacgttactatctgaacgtattatcatacccttctttaagtcatactcaattatcatctgctgcccatttgaatgaatcacgggacaataataatagtcatcgattggaattaaaggaataattctatcttttttccctccatctggtaaaattgaacataaacgattcatctctgactcaatcaaagggctaacagtaatcctcacatcatatgttcgttgagaaacagtaattctgctcatatcaatagaatttcgatccatatctctccataaggataaaacattattaaccggatcccacctgcataaaagaacctgaatcgtcggatctgcaagacgtgttttatctacatcatcctccccccatagcccggaaccaagttcatatcccgatgatatattcagtgcacgactccccgctaaaccttcagccttcctgtctttattttctgtctctttatcccgctcaattaatgcagatggtatatatggaggtaattgaggatcatacacagattcaatcaaaaatcgtgatctatcaggagtccggatcgaaccttcacttcgaagcagttctgcagtcttccacaacagaccatgatatgggtatacataccctccaccgggaaatacctctgaataccatgaatctttcggattgtcatcaaaagagggggaataaatcgccagtaccggcttgtctctcatcccacggctatgacgatgcaaccgtcctgctcgctgaataaccaaatcaatgggtgccagatcagtaaccattacatcaaaatctatgtcaagggactgttcaaccacctgagttgcaatcaacaaaactcctctgcgatcttcatccagactctgtgtcccaaattgagtaagcacttctcgctctcgttcaagacgatctcccatagcaaaacgtgcatggaacaatagaattttcgacgcaacatcgcggtctttcatcatcttatatgccgatatcgcatcagatacggtattccgaatccaacaggcacattttccagatagtaattctttattcaggtactctgaaactccatcgattgtatgaaaaaaagtaaccttaacatcgcgttcagttccaggcctgcataaaaaaggaatttgtctacattcatgtggatgaatatgagttattaatggatattcatctacaaaatctaatgatggagcatatcctgctccattcgaaaaaccagtgatgtactcttccttctgatttttcggaagtgtagcagagagaagaatcgcacttccgccaagagctgcatgaaaagagagaagggaacgtaacaaacgattcataaaccggtcataagcatgaacctcatcaacaataagaatattcctgacaataccaaacaaacggagagactgatgtttgacagggagcactccaataagcccttgatcaatcgttccaaccccaatggatgcaagaagtgaagattttttatgatctgctagccatcttgcacatactgcctcaccagattcctcaccttgaggatgatccaatccacatgagagatcatcagacggaccgatagtctgaagaaaagaatctgacaaatgacgggaaccatgagcaagaatcagtgagggacggttttctccctgacaatataaccgttgataacagtccttcatccgctcatacatcgcattcgcagtcgccatggttgggagacccacataaataccttccccatatccatcattcattaaacggtgagcaagagtgactgcagcctcagtcttccctcctccggttgattcttcaataataaacagatgaggtccggcccctaattaaagggtgctcactaactcctgaagcggacttggagctctttctccagcagagaatacaggaaataatgatcgaatgcccgtttcaggattcaccggataatcagataacccacaaaccggtaaggcccgctcagcaatatcaagagtttgtttccagtaaaccttaagcggtatcttactattatggaacgggaaaaatcctgaagagcctatccagtcagagatgataacgagccctgctagtaaccatgaaatttgagcactgatgaattcatcatcctgagtcgggattttggtattgagatcatgaagaaacagaagggcagattcttgtacaaaatctgaggcagcagagatgtcatcatcagtcacaaccagataatgaggggtataatttattgcacccatatcgggaggcattccatgatgcccaaatgtggcattcagacaatatttgtatcctaaatagaattctaacaaatcaccatcacaaagatttttggtaagattgagatcggttttttcaaaaattttttcaaatatcttgattccaagattgctatgatgaagctgattgcataatcttggatctcttccatgaatttgaagaaaaatatccttcaccattccctgaaaactttcagaaaacttaccaagatcatgaatagcaagaataaaacttattaatggaataacctgatcctgattaattctcagtgcagaagatatcctttgtaccagaattggatgatgagataaaatcctgtttccaactgccgcaacatcaagagaatgatatacgaggagatgatagcgaggctcacaatcaattctggcttttccccagtactgatacatacgatctgccccttgcataaatatcatgatcgtctatactgttatagagatgaccagttgaacattatataataatagactcgttttaattcattatttatccagatattttcgatttaaaaccaaatacgatcaaaacgaaaggttaatcctcacgattcaaccactcggaataaatgagggagaagaacaattcatcaaagaccttgccggctatctcacctctgaaaaggatcggtattccgggtatgaatgttttctcctccggaaccgtgcacgagtgggagtcggactcttcgaaaccgcttacttttacccggacttgcatcttctggatgatacgggggaaccgccagcaggtagtctttttagacccgcacggacttgcccatgacacagataaggaccgggaaaaacataatctctgcaaaaacatcagaaaagactatgaacccttcatccaaaaaagattaaaagacaaaggtatcacaaccgagatactccttgatgcgtatatcatctcggacaccgaccaaaaaacggtgagtgagacattccggggaatgccaacgaaaagccatgtcgtgtatcagaaaaatcccgggtatatccgggagatatgtgaggggcttgcgatagttcaattggatacatgaaataatgtttaacggggcgaatgagtactagacaggtcagggcaaacacatcagagagtcggaaccaaattgagcaatatttcttatccgagcctcaataaagccaaggttttacatttgcaaatattcactctcctttcagatagtcagaaggattccatatttcaaggtaaaagaaagcaataaaaaaaataatccattccaaataatgatctagtcgtgaaaacataccaaacaaaagatattccccctgtttacagggtagatttgtccgagattcaaaagaaggcaataaacgaatgggtcaaagattccacatacattaatgcggcagcacgatatggccataatgctgatgagtttaaaagacaccctgaaaaatttgatgaggcgaatcaacaaaagataattttagagagattaatttcggaagaatcactaaaacaatcgtatgaagtctttagaggtttgaaagaatatgatatcattctaacaaagaagacccttgaggaaattaaaattaccaataaagcgactgaactatttgacgatgggtttaatgctgtctcttttaatgaagatactcccctaatttatgcaaccccagatgagaatggagaaatatggatgtattcagcaaatctaaacgaagggtatcctgcattatttatcggtaatgaaaacccccaaagtttaggatacagaaaagagggggagattttgattaacagaaaaacgaaattcacaataattggggacgaaataatgaatgtgcaagatgcgaccggaactattaaacgcttagtatatattgaatatcaagggtgagtcacatggataatcgaaaaaaatggttagagaaatatgcatcacctgaaggtgcggtaaaggtggttggttctcatcaaataacagagggtgaaaaaattagattagaagcttggaaatcaaaagttattcgcaaatattcactttcttcatctaaataatcacggcatacaatatatataaatattagttctttatgcagtgagattgttgtatcaatagatacaaatgaaccatggaaaagtgatgacacacaggtcgagatcaatttattgatgaatatgaaagcattgtttacgctcccaattggtcaggggcaagatatcaaaagataatagcgaagaatccgggtctgatccagttgctcaaatggacacctcatgaggaggaaccattaactcggggcgctacctgataaatactttttccacagtgaagtaattgtgttcactatcatggtaaaatggccatatggtgcgtcccctaatcgaattctggatgtaattttataaatctgattcgttcattactcactcttaccctgttgatcaaagcatcaggtttgttggcatcaatcagatacttcatcagtgtcacgccaaagaagggcttttttctgaagaaaaaaaacatcatcctgaacatcagaaagaccgccagcccagctgaatttggtttcacgatattttctttctggatatcaagtaaaagagaatctatgtaatccaataccttctgctggtactcaggtgggagttgtcgagcccgacgttttatcacgcttttttcagtcataaatgccaatctacaatattttctattctctgtttgatgttaccgattaaatttgtcatttctattttgattgtcttaatattcagttaatcaccaataaaaaacccaattatcctccggatgattgaatacagacataaattcctactaacttggttatagccgatgggtgatgcaaggaaaccggcagcagatcgtcttccttgatccccatggacttgcccatgacacggacaaagatcgggagaaacaaaatctctgcaaaaacatcagaaccgagtacgaacccttcatccagaatagattaaaagagaaaagcatactaaccgagatactcctggatgcatatattgtctcggtcaccgacccgatgacggtaagcgaaacattccggggaatgcccacgaaaagccatgtgatatatcagaaaaatcccgggtatattcgggagatatttgagggactcgcgatagttcaataagatgcttgaaaagatctatactggacacagaagatattcctatctcttcccatattttcaatataaaagaggatactcaataaaaccatttaggctgaatattaaatggatcatacaaaaattatggaaaatcaagtgcattatgtaaaatttggtaggatgtcaaatcaccatgcaagaaccaggtaagtaccgtgtatgtaccatgcaagtattgttcatctgaataaatttccaaactaaaaaggcttattcttcaatcattaatcctttgaggtaaaaccagaacctattcaaaccttaaaagcggcattaaggtttggatgatacaggggaaccgccagcaggtagtctttttagacccgcacggacttgctcatgacacgaatagaccgggagaatcaaaacccctgccaatacattagaaaagattacgaacccttcatccagagcagattaaaagagaaaggcatcacaaccgtaatactcctggatgcttatattgtctcggtcaccgacccgatgacggtgagcgaaacattccggggaatgcccaggaagagccatgtggtgtatcagaaaaatcctgggtatatcagggagatatttgagggactcgcgatagttcagatctcgtaagattgttcgagagaacacctcgatgatgtttccatcaggcccaatgaatgaaaaggtgaccacttttagaacacataattattaccaggaatgttccatccatattcttttaatcaacggaatcgcctcaaaatctgaatcttctgaaattatgcatttcacaccagaattatatgcagtcgcgatgtgaatggcatcacgtggctttaatttataatgagagaagaaatacccagcagatttaataataatttcatcaaccgaaatgaatgatagcccttttaaatcaaaaagaaaagaagagtattcttcggcaacatcccgatttatcttttttaatagagcatatgtaaattcatcccaggttaggaatgaagtaatcgcagaaatattattattttcaactcgttgaaggacttcacgagaccattttcctttatctgagttatctatcgctgcataaatgaaaatattcgcatcaatgtaatacataccttaaagacctaatcgttcctttaactctaattcatactgttcatctgattgataatcatttatctgaaccctttcggccaaggctttaaattttgccacaaccgtcatttttttaggaactattatgatttttccttcgatgactgatatcatgacatgatcaccgggagagaaatctgcctttctccaaatttcccgggggattattaaatcttcattttctgaaattatcgtttccatgtctatcgtgaatatagtaatcactcaaaccaaatatgtatttctggtttatttgaggagtcataaacaactcagtttgcccctcaataccccaattcccatatcgtgatgaaaaccagatttaagaccggccaagaaaccgccaggccggcatagcaggatgaatgactcttcaatccgcctaaaaatcagagttgattcgaggtttcttttctttttctttccactctaaaagtttgaaagaaactcacccggatccttaactaaccattgggacctctcctttgtataatccccatggcctttatcatataactgcaaaaatctcacagcatcacccggacagaacccatgaatatcgaataccgttcaaaaacattgtcaatcatatccctctcagctcatcaggaagataccaccacttctctatcttatatgcttcatatggcacatcaactttaattttcccatcaacaatttcctgacaggtacgctccaaccgattcagtttctcatgatactgccagataatccctttgataaacaaatcatagtgttcaagcatatagactcgaagatcaaggagttcttcagtatgataccgctgttcaaatcgttcagctaaaacaagatccagatcttcagatgaccattgtgcaaagaccgggtaggacctgagttcataatatttgtcactcccatagatagcatcgtcaaacgcttcagacggactttttagttcagcccggtttttcttatatttgaaatagatctcatctgcaatatcggggatgacgatattatcccgatagaaccgcatcttcttctcaagttcgcggtacataccgattaaaccataaatcggaccaaactccggcagtgcaatacctgattcatagcctagacctgcatccaccacggtcagatatgattgggcactatccattacgcccatggcatcttcgatctctttccccacgatgttttgcccggcttcatccaccagacttccctgccagtcaggaatctctcgtgttaaattgtctttgaatgcagagatatcccacatcatattatctttcagagcgtaggtgattcccctgtccggtccaagtacaccggtttcgttcgccaccagggccttatacaggacctcatcagaatatttaccaaactgtgaggggagatagtatcgaagtgtccagataagttctccatagtctcgtgtcttctttgttgtatcttctcccttcaatcggccgtatattaatttccctaaccgaatcacttcagattcggcaaatttttccatatcagactgcctttctgcatatgaaggagtacaacccagtctatcaaaaatatccttctggtcatttaaacccttataaaccgcaccccaaacctctatatcgacagtagttgatggatcaatccatatatacaactcatattcattatttgtctgagtcccatcagcaacatcagaaatttttgatgcaataacagaaccaggtaatccatcaaaaatagacatttcccggccatccggccagctcataacccactcctgaaattcttcaggcgtttgaaatttttttgctgatcaatactcacaacgacgctcacataatcccccttcttattttttacccggttatcattttgagggcatgaaaaaggaatataccctccccaccgaacagtgtggacatgatttcctgaagtaggatatgattcccattcttctgatacctgaagatttgaagaaatatcagaactctgtggaagggcagaaatgagagatgatggaacatcccccgatacaggaaaaaccaaaataaaaataaagatcgctgatacaaacaaaggcattatcaatccattttgtttctgatgaatgaatgacatgatcaatttcccccaagatgccttcaggaaaagcaaccatgagagtgaatctgttattattcagcaggatcatacagaacaatacctgctatgtggatttctgattgtaccggtggcatcaatgcatgagtattcgcacctgagttgataaagtatgtggctcattcaaatttttccatgaacggccattatgccaaaaaagggaaagtataagcgaatcaggcgttatcaaaatttttactcaccatctcatatacctcatcaataagccgaccagcttccccggtcatatagagcggtatggataatatggtatcatgaaaactcagctctccttcccagaaccgaatcgcaaacggaggctttttctcttccatgtacacacgcagggaccggagcgtaccggtctttcctgatttcacttcaaccgggtatatcctgcctttcctggtgatgcagtaatcaatctcactcgagctcccggtcttatcccgtgcccagaaataaagttctgaactgatgaacggatcctcaagtgccaataattcctgaccgataaactgctctgccaaactgcctctgttaatctgcataacatccttcagactcataatttcagcattcaatccacaaagatgctgcataaggccaatatccagaaaaatatacttctgcttattggacagggttgcaccgaggggaagaccagatgcatctgttccatagacaggagtgatgacacgggcaaggctgagcaggtggagggcatttttcagatcgcgggatttagattcccggtcaatattcacatattttatctgttctgaaaccatccggggaattgccgaaaagacggtctgcagatgtattacctctgatgtcttgccatatttgtaaaaatcccgtttatatgtttcaataagtgcatcctggatatgtgagcaggtaagaaaactatctgactccaggtatgaggcgattacttcaggcattcctccaaggataaaatacgtccgaagaagagaattgagtcgttcatggactactttagggatggcatcagagatatgaacggagttcagatatgaaatgaggttttcttctcccactgccctcatgaattcggaaaaggtgagcgggaacatatttaaaaactgaactctccccaccggcattctcatttccggagtaaatgcaaattcaagaagtgaaccggctcctattacaaagatatcaggacgtaattctttaaagtaacgaagagacatgatagcgtccggacactcctgtatttcatccagaaatatcagggtatctttcgtgattttctggcgaaataatagttctatctgtgaaataatggaatttggatctttcgtgtgaaatattgatttgaaaccaggatctaaatcaaaattaagggcaacataatttttaaattcctttttcccaaatcgctcgacactataactcttccccacctgtcgtgcacccctgatgagaagcggagtccggtgagattttttccatgagaggaggtgtgacgagatggcccgatccatagttactatatgcagttcgaagaacatatataccttggctaaaatagggggcaatttttaccaacttttggacattttagggggcaacttcatccacccacccatacatttcaggggttccaccatcacaatcacccctcttcccatccctcttgccaggactcccatccaggaaccagccatacctccccacagccccggagcagattcatgatctccggctaaaccaaagatgagaacacttcaaaccgctcaattccttaaacccgccattattcttctcccgatacaaacctgtttaaatcacgatactatctcccttccaacacttctctgtcacacccgtgacaggagaaacgaatggcagactttgtctcaaaatcagttgtaaaaagtgcagagcgggtccttgctacccctctggccagcaaagccacattaaacaccatcgtcgggaatatcctcgccgacaacccgtggggatgcaccccgtaccagtcaggcggagagaccctcccggcggtggcaaaaagcagcgaatactactccggaaccatcatctatgagaacaatgaaggaaaacaggttggcaggatatctgtccgtgctccctcatccggtgcatttgacaccacgatatccaccctccttgcacaggcaggacttgagaccgccatgggaggaactgcatcacatgacagctctgaagatggcttttcagtcaccctcaaatgtcatgcagcgaatggagaactctataatgtcgcattcaaacgtgacaaggtaagtatctccagctttgaatcggatgggatcatgaccaccatcgagacctgggcagataccgtcagcgaactggcctgatcacccttctttttggaggtgacatgaatacccattattctctcctctttctcattattctcatccccgctgtaagcttttcctgtgctgattcccttacatcttccatcgtctgtaatggagcagcctttgtctcatcatcactcatcagccagggacagacctatgcagcagagttctttgcaagtgacctggcagttctcatcagaaccctcaaccttgacacagaaccaaaaacacagacgatcatcaatgcaaccggcccactcggaattgatgaatattccagtctgaccagggaatatgagaaagatagcccgctttgcatctttgaggatacccggaacagaacagattcagggtcacaagtccggactctgggcctattagatcagggagaatattcctcatcccgttcagtagccaaggagcttactgcattcactgctgtcaatggatcaggaataatccagatacgagccggaacagaggataaaaaccggacaacatcaatgaaggctgatatcctcggagacatgaacatgaccgaacatctcacccttggtggatcatgatcacatgggatcataccttccttctcacggtggtatcgctcatctgtgctgtacctggatacatcggaggaattctctctctcctctattatcgccattatgcagagaatatcattcaattcgtgaaatcatccgacaaagaattggaaataacgtgcatcagtaccgatagagaaggaaatgttcacatcaaaagcccctttgatgactgaataaggatctgaatccataattccattgcagaaatcgattcgatcataccaggatcctcatccctctttttccatactttattgatcagtacattgcgaaacaattcgatacattctgatacattctgatacctacgcatacaatttgcgccacatagataccaatagaacacggatatttatacccatgcccgctgatttttaagccgatggggattctataggatctcgccacaaatgatttcgaatatgcaggaataggggcgcattagcgcggagtagatagcagaatgagtattttttttaactttatcttctcagcgaataatcgagctggtgatagacaataatcccgtaatgtttatatttacaggccctctaaatacgaaaggctccaatacctgtggagcagtgtgaatatcagagaataagtgattattcacataaattgtagagaattcagagcatttttaggaagtgacctctaaatggccttcacatcgatactgaaaaatatgatgaaaaaattaaccggaatggtgatctattgaagagatttacacgaaagcgaacaaataacccccacatcgtcaatcaccgaccaaggaaatcgaactctgcaggggtaatatgttattatatacgtcttgtgttaagagagtttgcatgcaccaacggggtgagatcgtatgtctgacagcctcactcttcgtgctgcaatctatcatgcactggcacgactcagcctctccggataccaggctgaacggatctgtggcaaaacacgactctttgatatcatcgcctggaataaggaacggatagtattccttgccatcagaacctcacgaaccaggtctcttacccggttttctgaagaactgatctccttgtgcagaatggtcaacactcatccggttcaggtgcagatccagttctggctctattgtaacgcagaatggtcacaataccaggtactcagcggaggagccatgccaatccgggagggatccctgtgaaagaggagtatatcgatgaagtcctccatgcagttatgcattccctcagggagaaccagacactcatctccagaagagcgatagaagaaatcatcaggaatgatccctacctctatccggcatttcgttccctctctcccacctcacggcggacaaagatcagcatcatcatgaacctgcacttccccctctggataaaaggaaagggagttcatcaaaatacctatgtctggaaggtaaaagacgagaaagaggagtgagggggcatcatgacatcccagatacaaaataccctacacaccctctttcagccaggatcagtccttgaacttcgagccctttggaagaatggcggtgttgcatcaggatactacaccgattatgagaagatggcccaggatgcggcaattcttgacgggttatcagatatagcaggaatctatgttgtagcaaatgagatcaatccggacctcttcgcacggcgggcaaaccgtctgaatatgaagttgtctagggacgataagaccactggtgacgaagatatcattcatcggaactggttcctaattgacgtagatccccggcgaccttccgggatatcatcaaccgatgcagagcaccaggctgcccttcacaaagccaaccggatcagggaattcctctctgaacttggatggcctgaaccagtctgtgccgactccgggaacggggcacatctcatgtaccggatagaccttcccaatgatgatgcctcacaacgcctcataaaatccgcccttttagtcctctcagcattcttctccgatgaacagtcagatgtagacaccaccgtctccaatgcagcacggatatggaaattatatggaacactctcacgaaagggtgattcaaccgattaccggccacatcgtcgttccctgattcgatctcgtccggatgtattagaaattaccacgtatgatctgttcctccgcctggtatcgcttctccccatgggtgaggatatcaggacaggaatagaaaaacaaggcatcatcccccgggaagagggattctctcttggaacatggttgcagaagaatggattctcatgcagggaaaagccctatggaggaggcattctctacctctttgatcagtgtccgttctcatccgcccatgctgacggagcatatgcaattcagttcgccaatggcggcatattcgccggatgtcaccacaattcctgtggcggcggaacccagcgatggcaggaacttcgtgaacgaatagaaggaaaacgtcctcaccgtgattatgacacctggcgacgggaaggaatcagaaaacgggcacgggataaagcagaacgtgacggtatacctgaattaccgggtgcagaggaatggaaaccagccgatgaagataccaatattaccccgtccgaatctgccataagcccggataaacccagtcagaccagtcatcccagacatgaagtttcaatacccctggagaaccgtccggagatctgggagaaagccatggagattctacatcacggaaacccaattcaatacctccttgacaccttcgcagaacatcatgtcggtgacgggattgttgcccgatgcctgatcatgtcacttgcatcccggctggttgaaaattcaaaggggcttcatgtgctggtcaccggagaatcaggaaagggaaagtcccacagttttgatacgatgctggaccttatcccagaagaagacacccttgccggccggttcagtgacaaggccctcttctatcttgatgacctgaaaaagggatcagtcatctgtcttgatgatgtatcactctccgaaccaatgcaggagaccttaaagggagtcaccagtagttttcacaaacccttcatctaccggacggttgacaaggaacggaaaggtctggtcaggattattccggaacggtgtatctggtgggttgcaaagatggaaggaacgggtgacgaccaggtatggaatcgtatgctcaccgtctggatagatgacagcatcgagcaggacacagaggtcatggcacgggaacttgcagcagctgcacgatccacggccctgcatccagagatatcagagcggacattcatctgccgggcactctggaaggagctcagggaatacccggtcctcataccctatgcagaacgaatcaggttcgcatcggtccggaaccggagaaacctgacgatgcttttggatctcatccggtcagtcgcactcatgtaccagtatcagcgtgtgattcaggagacaaacggagttaaggaagttattgcatcagaggaagatttcgccctggcaaaggagatattcctactcatatccggcactcatggcggccagtataccaaactgaccaaggcagagtatgagatggttgagatcatcagaagagagcatatcgtctcattcaccctgcaggagatgcagaaattacttggaaagtcacgaaccgccacgtaccggattattcatcccaaagatccgaataaacgtgagtatgaagggttgcttgagaaatgcccgcccctctcctttaccaagcagtctcttctgcttgagagtggaaagcgtcagatctgtaatgtctacacctgggattatgagatggatgccgtatggtcaggacgtgaggggtgttggctgtcatccgatgacgacgatgatcagtctgatgagatgaaccgatcacctgtgcaggtgtgcccccctgtgcccgtggtgttttcagaaaatgacacagcaatcaaaccccgtgatgcagaattaaatcaaaacacagaacaatccgggtcagaaaaagatggtgtgcgtaccccggcaggatcacagagcccggatgtcagtgatcataccggttcctgtgaattcaaaaataatgcacaccgtacacagagtttagggaatacgaataattcttcacctgattctgaaacggtacctgatgtacctgtgcaaaaaaatgagaacagagtgggatcagggtgtgcacaggatcacagcgtgcaagaatcagatacagatacggatacagatacagtcacaaagacacgtgatcgatttctatcaaaatcagagattgatccagcccggtgtatcaggatagaaggaacaggagcacataccagagtctgtgatagttgtggagcgactggaggcatatacgaactcagggcagggattcgaatgccagttaccaatgctgttccgatcatttgtgaaaagtgccatagtgcagcggttgcacgggaggtattatcattccgggctctcccaggactcctgccaattgccaacatgaaaccgtttgataaagagggggtgccatgttcgctctgtcatatcaaccggattgcatggctggatgacgagacaaatataggcctgtgccagacgtgttatgagcgggaaaaggatctttccgccagagagcgtgatacacgggggactattgaggagagatccgatgccatttgagattgtagcgaccaggccggcaccggatcgaacctacacaaaagtgggacgactcattgccggtgaggacggacaggtccacctgtttcttgatgggaagggagagatactgactattccccgaaccgatatcctgtgtactcttcaggggctttcaattcagggactggttctttcggataccgggaagcgattgatcgtgatcgaccgggatggtcgtgaataccaggtgctggtcagtcaggtccgggagatgttccggtcctggccaaagaagaaggctgcggtgtttgttgatgaagagagggtaaatacccctatctcatgagatttacctggaacacacatcagataccgacataccatgacacaggaactcacatgaaagactcagatcatcaatacaagcgaatattcagtcatccccggatggttgcagatcttatacggggttttttggatcctgcccttgctgatggctgtgacttttcgactctgaaacggtgtaatgggagttatatcactgatgatctcagggagcgtgaagacgatatcatctggaaggtaacatacggggaaagaaccctcattctttacatcctcatcgaattccagtccaaaccagattatgccatgccagttcggattatgacatatatgggtcttctctggcaggatcttatacggacaaaggtcataaacccgattaaaccgttaccggcaattatgccaatagtcctttacaatggaaaacaaccctggagtgtgccggaagatatcaaaaagactattaacgctcctgaaccacttcacacatttgtcccgtcagttccatacctgctgattgatgaactcagactatctgtgcatcacctggttgaagtcagaaatttatcagcatgtttgttcagacttgaacagtcggcagggccggtggaacttatagaacttggattcagattaaaccagtggatggaaaaagatcctggacttgctgagatgagaagggatttctcgttattctttgagaataccttaatgagagatcaggatatacctatacctaacccgtttgttggagggaccatgttagctgaaaaagtagacaagtggattgcagcatataaggctgaaggcagaattgaaggaatggcaattattctggagcggatgaaaaaagcagggatgtcagttgccgagatcgcaaagataacagggatgccagaggaagagatcagatctctgatatgagtccttttgcagctgaccaatccttccagaaataaagttacttttccaatcttcaaaatatgcaattcaacagagtaatatactatctatagttgatgaataaaactccacccccatgacttcgttaataatggaataaaaccaatttttcagaaatcagataatatattcatagcagatacgacataccatgacacaggaactcacatgaaagactcagatcatcaatacaagcgaatattcagtcatccccggatggttgcagatcttatacggggttttttggatcctgaccttgctgatggctgtgacttttcgactctgaaacggtgtaatgggagttatatcactgatgatctcagggagcgtgaagacgatatcatctggaaggtaacatacggggaaagaaccctcattctttacatcctcatcgaattccagtccaaaccagattatgccatgccagttcggattatgacatatatgggtcttctctggcaggatcttatacggacaaaggtcataaacccgattaaaccgttaccggcaattatgccaatagtcctttacaatggaaaacaaccctggagtgtgccggaagatatcaaaaagactattaacgcgcctgaaccacttcacacatttgtcccgtcagttccatacctgctgattgatgaactcagactatctgtgcatcacctggttgaggtcagaaatttatcagcatgtttgttcagacttgaacagtcggcagggccgttggaacttatagaacttggattcagattaaaccagtggatggaaaaagatcctggacttgctgagatgagaagggatttctcgttattctttgagaataccttaatgagagatcaggatatacctatacctaacccgtttgttggagggaccatgttagctgaaaaagtagacaagtggattgcagcatataaggcggaagggaaagctgaaggcagaattgaaggaatggcaattattctggagcggatgaaaaaagcagggatgtcagttgccgagatcgcaaagataacagggatgccagaggaagagatcagatctctgatatgagtccttttgcagctgaccaatccttccagaaataaagttacttttccaatcttcaaaatatgcaattcaacagagcaatatactatctatagttgatgaataaaactccacccccatgacttcgttaataatggaataaaaccaatttttcagaaatcagataatatattcatagcagataccgacataccatgacacaggaactcacatgaaagactcagatcatcaatacaagcgaatattcagtcatccccggatggttgcagatcttatacggggttttttggatcctgcccttgctgatggctgtgacttttcgactctgaaacggtgtaatgggagttatatcactgatgatctcagggagcgtgaagacgatatcatctggaaggtaacatacggggaaagaaccctcattctttacatcctcatcgaattccagtccaaaccagattatgccatgccagttcggattatgacatatatgggtcttctctggcaggatcttatacggacaaaggtcataaacccgattaaaccgttaccggcaattatgccaatagtcctttacaatggaaaacaaccctggagtgtgccggaagatatcaaaaagactattaacgcgcctgaaccacttcacacatttgtcccgtcagttccatacctgctgattgatgaactcagactatctgtgcatcacctggttgaggtcagaaatttatcagcatgtttgttcagacttgaacagtcggcagggccgttggaacttatagaacttggattcagattaaaccagtggatggaaaaagatcctggacttgctgagatgagaagggatttctcgttattctttgagaataccttaatgagagatcaggatatacctatacctaacccgtttgttggagggactatgttagctgaaaaagtagacaagtggattgcagcatataaggctgaagggaaagctgaagggaaagctgaagggaaagctgagggcagaattgaaggaatggcaattattctggagcggatgaaaaaagcagggatgtcagttgccgagatcgcaaagataacagggatgccagaggaagagatcagatctctgatatgagtccttttgcagctgaccaatccttccataataccttaacatttctcattttttctgtcatatctttcgatttatccaaaggacatacgagcagagtgaaagttcccaataaccaccctgaagccttcagaaagtgaaaaaattaccctgcattgacttcgagtatagtagaacaatattgcaacttaacttatatcatactatacattcatatcagatgcaatgtaataggacatcatacagggtctctcaaaacttgggatcatggcaattctccatgactggaattactggtacagggatttcccacagtttattccccggccagaatatcaggagaagatgcagcggttgcgaaggtctgatgagatcattgtgctgaccggcatgaggagaagtggaaaatcaacactgctcaaacaggagatggaggatcttgccagaaaccatgacaagacccagctcctgtacatcaattttgaggacccgcggttcccacccgctatggatacttcaatacttgaccaaattcttgcaacataccgggagaatataaatccggataaagaggtttatctgttccttgatgaagtgcagaatgtccaatcctgggaaaagtgggttgtaacggcctatgaattgcaaaaggccagaatatatctgaccggatcatcatccgcactcctttccggtgagattgcctcatccatcagcgggcgatatctcaaaattgacgtgtatccattaacgtttcaggagtacctgctctttcacgacatatcatgcaccagtatcactgagtataccacaaaccggacgatgattaaccgtttatttaccggatacctgacctgaggtggttttcctaagggagcaatgcttgaagaagacctgaaaaaggaagagttattgtcatattttcatacgatattgctcagggatatcatggggagatataaactgcgtaattatgatatcctgctcatattggttgaatatcttctcaaaaatgatacaaatcagaataatatccacagcatcagcaaggccctttcaatacgttatgaaacaacccatgactacattgattatctgaaacaggtgtatttcttctttgaagtcagaaattttcattattctctgaagaaacaattggtgtcggatataaaattttatgcccttgataccggatttgtaaattcagttgctttttctttttcggagaatattggaagactgtatgagaatgtcgtatgtaatgcactcatcagaaaagggagacagatatttttctttcgtgatgctactcatgaatgtgattttattgtgaaggagggaaacaaaatcacgaaggcagttcaggtctgctagcacctgaccgaacagaacttgaaacgagagataggtggcctggtttctgcatgtaaagcttttgacctgaataccgggtatattattacagaacaggctgacaggatcatggaggaagatggagtggagattcgtatagtgccgattgttgagtatttacttgggttatctcatacaagtattcaattttcataattatttttccggcaaattccccatcatgagtgattagtgctgattattcgatttaaatgttcactaattgcagagatatcatttaattgagtctttaaaacatcaaagacaagcacatcattaatcttcccatattgatgaacaagaatatttctgagacctttcatatccttgagtaattcacccatttccggatcgagatatccggattttacaagattcccaataatatcatcatcattcatcgggacaccaagtttaagatcccgattgagtattgcacaaatatcaaagatgctttgaagtatatattccagccttttgtataatccatccttcaaaagtccaagattgataaactcatcataatcatccgttacaggaagattatcttggattattgaaagagaaagatcaatttccgataataaaaaacgtatcttttcggatctgattggatgagtatggatcataatatttctctctccccgatgtaatccagataatgcggtttaaaaaactcatactcccgggaaattttcagagccctatcataaagttcatcttcgtcggccacatagagaacctctcccttaaaaacttctacctgaacaaataatgggagatgctcaaagatttgaatgtcaaatgtatccgatactcttccgaggatatgcattctcattcgttcagcctgaaggtctggaagatctgttgaaatggcaatatcaatatctgaatgaatgtcgtcccttccttccgctacagacccatagaggataataaaccggatgttcccaaatacgggagttgctcgtatgatctccatgcaggagtgaatgtcatctgtgagcggtttgacaggcatacatatttccaatagaaagcaggaggtctcatttatatagtgttttttacccttttatgttttgtgtggcaggtaatgggtatttaagggcatcatcctcatttgggggtgctgacagcatatacaggcaaaacggatgcatcaaaaccctggttggtaaatcgatgaagatcaaaaaactttttcagattatataaatcagatatccagagatatatcgaaaataaacctgtgattctgaaaaatataccttgaaaaagataataacgtgtgaatgatatacaatagcaccgtgttattgcaaataaatgaatcaggagagataacgatcactttggatataatcatacaatcgggtatgaatcccggcgagtatatcgaaacaacgcttcaataagatggtaataattaaaagatttcacaaagagatttctccaagggaacagggatttaataataaaaaagatgattgccgaacatctgatccctcggcttattatgggtcactcagtcatatatatcaggggagaaaaaaagatattctcgcaaaagaacttcgagaggatggaataatatttgaccagatcgctcacaattttcaggcaatacgcactccatcatgaatgacattctgaagaaaggaaaaagaacaatattcatcaaattgttttcttgatcgatatttcggagagatatctattccagtctccatgaatacatcaaagctcagtccaataatatcaaactctacttcacaactatcatcagttccaatggtcagcaggttaacatctgatttttcattattttcggaacgtgcaactgatccatacaaaataaattcctctatacggtcttcatattttttccgtatcagagtgagataccgttcaatagcatcttttatccggctattattgagagggatctcctgaatattcttcacatacactcattattattgaaaggagaaataggtattgtcagtcctgaaatagacctaaatttaaattttaaatttcgtcatctcccttgagatactctcggctatcccactcacatttgcaacaaccctgccaatctgttcaatcgaagccgatgcctcttcggttgcagcagccgcatcctgagcctccctggcagtaccctgaatcagaacggatacctcattcacacttgccgtgatctcttcaaccgatgcagcctgttcttcggatgatgacgccatatccatcgcattccgggtgatatcctcaattgattcagcgatcttcgtaaaggcactgactgtttcttcgagtgcatggttcccgtcttcaaccgcagttcctgcagcgattatcgcatcatttgccttctttgcctttgcctgcagatttgcgatcatgtccgctatattctcagctgatgcacgggaatcctgggcaagggactttacttccgcagcaacaacagcaaatccccgaccagcttctccggcccgtgcagcctcaattgcagcgttgagggcaaggagattggtctggttggatatatctgtaatgagacggacaatctttccaatctcctccatctgctgattaatctcacgaacaatctgatccacctcacttgttgaaccagtaattcccttcatagcagactcagactttttcgcaagatctataccctccttagagaattggtttgcctccgttgcagaatgggagaccttttcagcccgttgtgaaacctcaccgacggttattgtcagatcctccatggctttgagaacctgggttattccgtcatctccctgctctgcattggcactgacactcccggtatttctggcaatctgttgtgcaccggcagatacttcctcaacacttgcggtggcctcttctgcattcgaagcaagttcaaggatctgcttattaatcgctccgatggcatcgcagatctgaatgccgatgttgtcaagagcggtcttaaatccgacccagtctccggccaccttcagggatgaatcaacccgtgcactgaaatttgcattggcatactcatttgcgacacgaatcgcttcctggaccggggtgacgacagattccagtgtatcattaatcccgctcagaacctctgcaaaatctccggtgacctgggtgatatctgcacggtttttcaggtctccctgaatggctcctttcgcaagactttttgcctgaacgaccaggtttttcacggaatcccgtgcacgatgaagattgacggtcagatcaacgatcttctttcggacatcatcagtatactgatctgattcagggattcggacttcaaaatcggtctttccatttgcaaacataccaaggcagtatgagatattccgaaccgattcatcaagatatttctcaaccttcttaattgcggttatatcctgaataacttcaacatgtccgatatcctttcctgaagcatccttaacataccccacatcaactttgaaaaatcctccttcctgttcaaagaaggtttctctcttccctgccctgagacactcaataccgcaatcttttgtccggcagatatttgcattccaccggttacactgagtccctatagcctgttttttgtctacgtttgccatcttagccgtggcaggattcaggaatgtccagttcatgttcaggtcggtaacagaaaccgggaatgggattgcatcaagaatagactcaaaccaggctaccttatctgcaatcgtatcgactgtcgcattgattccttcaataatccgacggtattcaccctcatgcctgctcacatcagcccggacattaaagttaccctgcgatgctgcatcgacaagcatggttgtatcccgggttaatgcctgaaggttttcaaatgccttaataaaaccaggaacgatacgatcctgttctgaacgtcttccaatctgccggtactctgcaagttctgaaagatctccgtgactgatcttctcaattgaacctgcgatgtgatttacccggtcacggacagcattaatattcgatgcaagagagacaaaatcacccaggtatgcagattcatccatggccttcgtatggtcatttaccgccatccgttcaagaacagccccggcatcccgaagcggtgtgataacggcatccagagaattatttatcccttcaacaatcttccggtaatctcccaggtgttttgttacatcggcccgtgtttcaaggcgaccttcgactgccgctactgagagcataccggcatcactgatcagctggtgtatcgcatcgatacaattattcagattatttttaatctcattgaaatccccgttatactcttcagtaatccggggtgggagatcgccttttgatatccgatctacatattctgctgcaacattcaatggactaatgatgctgtccaaagtcccattgattccttccatgagaagtttgagttcccctgaatacggtgccggatccacccgggcatcaagacttccagcctgagactgttcagtgagggcaataatatcacggactgcattcttctcttctgtcttatcgatataatatgcaaaaatcgagaggaggttaccatcttcagcaaaaaatggcgtgtaataatactgaagatgtttagtcccactggcaaccaccgcgtccagatccccatgcacctggcttttcgtctcgatcccttcagcaagggatccgcctgcccggttccggacatcaaaatcggtaactttcatcttctgaatttcttcgatggatttatcagtcagaacggcaaacgcatggtttgcgtacgttattgagagatccggtttgagatcgatgatcggagtcggggcattggcgataataaactctgattttttcctgagcgcgacaacatcggttatatcaacaatcgtagccataagacaggtctttccttcatattcaatgagttggagagttacctgacagggaaatatggacccgtctaaccgtttatgttcccattcaaaactgacaacttcaccggaaaatgccatctggatgaattgtgcagccccctcatttgaatcggtcccattcctttgtttttcaggcgagaggatcgatggaggtttgccgatgatgtcctcgacagtattggcacgaaacattgcatacgtagccgcattacaatcaatgtagaccccttcaggtccgattatctggattgaggaagaagtcgcatccaggatattctgaagtgaggcgatgtctgaggttcgagtttttccattcatgatattcccatcctgaccgatatctgaagatataaatttataagggatatagatatcggttcagaaccacatgggttcgcatatagagtcccgatagagtgcatggacaggcacgtactatatttcattgaggcgcaggttattgatcatttgaaatggacaaatttatccaatgggaatggataatttaatcaatattcaatacgagtactacttatgatactcagggatgacattacaaagatagtcaaatcccagagaaattcaataattaataggaatcaaggagttatccgacacgacattataaaaatacatcctcatcagaattttgcgatcatcctttcaggtataaggcgatgtgggaagagtacacttcttgtgcagatgatgaaaaaggaggaaaacttctattatctgaattttgaagatccacgactaatcgattttactattcaggattatgaagtgttagaggaggtatttcatcaggagtatggattccatgatctgtatttctttgacgaaatccaaaacctgtccgggtgggaatattatatccggcatctcctggattctgaaaagaaagtcattatcaccggatcacatgcatctttactgagtcgtgaacttgggaccaaactcaccggcaggaacctgcgactggaattattccccttctcatatcaggaatatctcgaatatactcataaagaggattctgatacctcattcaatgactacctcttcacaggaggcttcccggagtatatccgagtgggcctggaagaagtattacaaaacctgcttctggatattattgcaagagacattatctaccgtaacaatattaaaaatcctgcactcatcactgaaattgccgtgtacctgcttggaaatatcgccagggagatgacactatcacaattacaaaagatcttttcagcgataggatcggtcacaaccattgcctcctatatctcccatctggaagatgcctacatcctctttactctgccacgttttagttattctcataagagcagacagatcaatcctaaaaaggtatacgctgtcgataacggacttatatatgccaacaccacaggttttactgaagattatggaaggcttttagagaaccttgtatttatcatgttacggaaaaaatacagggagttattctatttcagggaaaaacatgaatgtgattttattgtaaaggaaaagaccaaagtcaccagagcaattcaggtctgttatgaagtaaccagcaggaataaagaccgggaaataaggggtcttcttgaagcgatggagatgtttgatctgaaagaggggtatatccttaccgggaaacaagaggatctgctcaccgtcgacgggagaacaattatcttaatgcctgctcgttcctttgcagggtaaccttttttattttaatgtattgagagtgataccattctgacaaccggtgtgagtcctggtgagttcaaactctataaatgtaaaaataacctctgggatagtgcaacaccagtcatagttgggggccatcatctggctaatctctttgttggtcagtttctctttgatgatcagcctttcgatagagaattattccgaaaacaggcagagaaatacggttttgacatggaagcatatcttgctgcattagacgaggttccccgatggaaccatgatcaggtcacaaagtcatgaaatttttcacccgtcttgccggattaattgcagaactgattatgaataatatcagactggcacgaaccctggcagaacacaagagggacattccataacggcatcattctgattacatgagaagattttattgaaaaaatagaaatttgccatcattttcttttttgatagactaatgccccttttaccgggcatacctgtgtgcatcgcccgcataggaagcattccgacttattactatcggcatatgcttcaccaacaggacaaaccttctcacattgtttacaggagatgcaggcatcggtcctggtaagcctcatgagtgagaaatacgaagccagagtaagaaataacccatatggacagataaatctgcaaaatggacgatagataaagagcccaaggagcatgatacctgcaaacaggtaaaatttcacggaggtatattcaaggaaaaagaaatatttcatgccaatacatttgaactggaaattcggaaaaaacagggcaaaccagacaaataacacaaaaacaacaatatggatgataagaacagaccgtttccagggaatcgctatctttggagtcgggactttcgaaagtaactcctgtatggcccctataggacagactgcactacaatatgccctccctccaattacagtcagcagaatgaagaggaacaggaaaaacaagatggcttctaagggcattcctaatttccgaatttcaccaaaaagaacctgttgaaactggtatggtaaaaccggagcaaatataagaaacccaagcaaggttgacagaaccagcagaacaatctgaaccgcaggtctgaaaagtccttttttatagagataaaagatgagagggactgcaataagagcatatataagaccgaaaaattgtgggacagatgaaagaaccataacaagtatcattccctgcaggaatcttaagactttgggaaccaagtaatacctggaaatggttggttcatacaaagcgtcagagaaaattcagaacatgtacgttcgattatgaagttctataaacgctcttcctgctccagctttgtggcaaatttataagccatgacacggagcgatgcagttccggccatcagggtgttcgtatacaatccctaacctttggaaagaggcctgaaggttcctttcagaaccgataccccgataagaatgaccgactgcagagtatcaaaaacatcggcagagttattcccacgggtttcagactcataaaatatttttggatcagctactccgagagatctgcccggattcttcagtcatcctccgcattgtgtgagggagatcatccatatcgttcatagtacccgtctgatcatgcatctttataaaacccggatttgacccgcatcagaaatcacctgccagtattacctcacatatttttcctgattcatggcctgcacttcaggagaataatatataattatttatatatttggatctattggtaaggaggcgaattcggatgaatgattctgaccatccttacaaacgattgttcagccatcctgagatgatagcagacctcatcaggggatttctagatcctaaactggtatccggctgcgatctttcaaccctggagcgatgtaatgggagttatgtcactgatgacctccgggaacgggaagatgatatcatctggagactagcctatggagaccggacactcattctttatctcctgattgagttccagtcaaaacctgattactccatgccaatcaggattatgtcatatatggcccttttatggcaggatctgatacgatcaggagtgatcgttccatcgaggataccaggtattattccaattgtcctctataatggagaaatcccatggaaagtaccccatgatatcagagagacgattcagatgccaaaaccggtgagcagattcatcccgtcggttccttatctcctgattgatgaactgagactttcagtgcatcatcttatggaggtcagaaaccttgctgcatgtttattcgggctggaacagtcatcaggaccgttggaactttttgaactgggagcgagactgaacagatggatgcagacagatcctaatttggattcaatgagaagagatttttcattatttttcgaaaatacattaaagagggatgacgatatatctatatcaaatccatttcagggaggaaccatgttagctgaaagagtcaataaatggattgcccaatacaaggcggaagggagaaaagagggcaaagaagaaggaaaaaaagaaggattactggagggaagggtagaaggaaaattggaaggcaaactggaaggaatggcaaccatccttaaacggatgaaagagaagggaatgtcagttacagaaatcgcaacaattaccgggcttccagaagatgaaatccagcacctgatctgaccagttccccattcatctttcagcttttttttctacgcttcaattcatataagggaccatccatcagatccaatcgatcttacccaggaaacaagctatagatctcaaccgatatataaatttatctatatcgatccccattttccatcttttctttttcactcatatccaaaatttaagttgtgtgattttggtatgaatatacgattaaaaattactgactggctgaataatgccacaatcggaaagaaaattaccctgatttgcctgattcttgtcattattcccacattggcactgggatttatcgcgtataactgtgctgaaacagcaatacaggagagtcttcatcttaatctggatacccagaacgaggatatcagagaggcaacaaataccgtgtatggtcttactcagggaaaagtaaactcagacctgaatgtcctcaaggaactcttctttgccaaaggacagccgaccattatcaatggaaacatgatccttggttcatcatacaaagtgaatgataattttgagatagttgatgaggttcaaggacttcttggtggagctgccacgatatttcagaaaaaaggcgaccaggccatccgaatatctaccaatgtcatcggtgaggatggaaaacgtgccataggaacccctgttgctcaaaatgtatatgatgcagtcataaacaaaggacagacatattatggaactgcagtcgtggtagggaaaaaatatatcaccgcatatgaacccatcagggaccagtcaaatgatattatcggtatcctctttgttggagttgaagaaaaatccaccataggtctgcttgaagaccagataaggaacaagaagatcggtcaaaacggatacgtatttgtggtggatagtaaaggagacgcgattatccatccgactgaagctggcaagagtatgaatagtctgccatttattcaggacataatagcacaaaaggaaggatatatcagatatacataccagggcaaagaaaaagtggcttccttctcatactttgaaccctttgactggtatattgttgcgagtgctgaaattgaagacttcttagggccggtagaagcgatcagaaacaccatcatcctggttgtgctggctggaattttgggcggctatgtcgtctcgtacctgttcagccgttctatctcatcacggatggaaaagctggtcagccttgcaaaccgggtcagagatggtgacctgtccggggatgatggatccagccatgccaaagatgaaatcgggatcttaagtcgggcattttctgatttgattactacctttcttgagtttcgaaacgagatccacacaatcagcaccgctgcctcatccggagatctgaacgtcaggggggatgagaggaaattcaagggagattatgccgtcataatcaatggtgtgaacaagaccgtcgatgccatggcagttcccctcaaagaagcaatgagcctctccaagaagtatgcatccggtgatttcagggcacgcatgcgcaaggatttagagttacagggtgaatttgtcaccttcagcaatgccctgaatactattggtattgatgtgtcacaggcactctctgcggtcataaatcagatggcccacctgaccggtcagatgaaagaggtcagtaacagagtggatgaagtaaccggagagaccgaggaggcatataagagcattgaggatgtttcagaaggcaccggacaggttgccaagattgctgcggcagtcaatgatcttgctgataagagcgggactacaacacaacagattcttgttgcaatgcaggatcttgcgacaacagtgtcatctgtggctgcgaagatggagcacgtatccgaactgaccagtactgctgcagaactctctgaaaaaggaaaggctgcagccggtaaggcagattctggtatgcaggggatcatgcaggcttcgtcggttattgatcagatgaaccaggacatcagtgttcagatgcaggagataggacgtatcgtagacattatcagttccattgctgaagaaacgaacctccttgcattaaacgcagcaatcgaggctgcccgggctggagaggcaggactcggatttgctgtcgttgcagcggaagtaaaggaacttgcaaatgagtcccagcaatcagcggagaatattgcagggattattgccggtctgcagaagaaatcagttgccatggcagatgctgttcaaaagtcaatccatgaggttgaacaaggaaaccaggcagtggtgcagactcttgaagtctttaataatattgtttcatccatttcagtcataaacaacagcatgagtgaagtggctgcggcaagtgaggaacaggcggcatcggttgaagaagtgaccgcaagcgtcaatgaattcagcgagatgatacaacagaccgcgaaggaatctgtcggtcttgctgctgccagccaggagtcctctgctgcagtggatcagatctccaacatggtcggccaggtgaatgaatcgataaatcacatcagaacctcaacaagtgaggctatggatgcagtacataccattgaggagatgatggagcagtttaaatattgatgatgaagtcatcttcagataatttaataaaataattaaatgatcaatatttaatttttatatataaggatttctaagaagaggatcaaaagatcgttcttcatatgtacaaaccccccagtacatagtcatgccaggctcacgtgttgaatcagatatccttgacctgttcagtaaggagaagaggtcttttaccatatcacaaatcgcacagttgactggtcatgacaggagaaccgttgctcatcacctggccctccttcatcagtccagaaatctggggatgattcagcatggagtcagaaagaagtattttgtaccggataatgtccttttgatctcccgcagtctgtgtgcccatatcattctggttatcaatcaggattattcaattcggtggataaatgatccctttctggaagttctgggatgcacacggaatgatattcctcatattaccctgacccatctggaagaaatttttcctgctatcaactttaaatcgattttaagccatcttgtccatggtcagacccgcttcatcaaagaatcgtgtgaatataacggagagcaatttacctacagattctccttttcagcgatatacattcaggatgaacctcagtcatttatcatcaccggacaggacataactgaaaatgagcggataaagagtgaatatcagaagaaagaacaatcgtatgagattttaatcagaaatatccccggcattgtattcagacggaatatcctgtctaataccattgaactcttttcagataaggtgtatttcatcaataaatcgatcccactggattcacatccctcctgtatcagtttttttgattcatttattcatcctgatgaccgggaccggcttatcggagtgttacaatatgccgtgtttcatcaggaagagtacgaagttgaattcagggtgattaattcccacggatatgagtttcatttccttgaacggggcagaccgattcttgatccatcaaataacacccagtatattgatgctatcatcatggacattacatctcttcgaaaaactacagaactccttgcagaaagtgaggagaggtttcgaaaactggccgatgttgcaccagtcgggatttacatcactgatagcagcggaaatctccaatttgtaaaccatgaatggtgtcggcagcataatattacccagaatcatgcaattggaatgccctggactcaggggatccatccggatgatagaaaactgttctctgccgataattcagagtcctcacaggcatacaagcggattatttaccggacaaacccggggaatgcaggatgtacatggatacatggtatatctgtaccaatagaggatcgtgaagggacgataacaggatatatcgggtgtgataccgacatcagcgaatggaaacggatttcctgtgaagaaagaccttttgaagccaatgacgctctatttgataaccaggccgatataaagcgggtgatgtatgatctgcagtttcacaaaattcagctcgaactcatcaataatgaactcgcccgaaccagagatgaattagaagagagccttgctcattatattgaactctatgataatgcaccgattggatatttaagcctgaatcagaatgggtttattaaaaagattaatcttgcaggtgccgccattctgggcaaagagagattggcagttctggacacacccctgtactcgtatatttctgaaatctcttcccaggttttctgggacttcttttcacatctgtcacccggagagagcgataactcctgttttctccatctgcaccgaccatttcatgattcggtagttgtgcatgttacagcatccatcaatgcatccgggaatgagattcatctggttctcattgacatcactgaaaaacacagagctgaattaagactacgagaaagtgagaaagcgcttgccagatcgcagatgatagcccaggtcggaagctggtaccttgacctctattcaggccagatgacctggtctgatgaagtgtacaggctgtttggcatacctcccggagatcctgtacggtatgacaccgtatttgagatgattcatcctgaagatcaggcgaaagttcaggcagcatattcagcgatccaggaaggtacggatttaaaacaactggatcaccggataatcaggcaggatacaggggaggtcaggtttgttcatgaatggtgtgtccatgagcgaagtcctgataatacaataatcaggacattcggggtgattcaggacatcaccaaacaaaaagtggcagaagagaagataaaggaacaggaggcatttcagcaattattgattcagctggcaacaaaggttattaatgtctcaatagacagaatcgacccgacgttgcaggagatgatggcagccatcggaaatttcacccatgttgaccgggtatatatctttcataatgacaatgaacggaagatatcacggaatacccatgagtggtgtgctccagggataaaaccagaaattgaaaatctacaggcggtcccatttgatttctttcccgatataatggatatgcttcagcagggagggccggcatatattcctgacgtgtcaaagatggatccgtcagaaccggcacgggcaattctggaaagtcagggaattaaatcacttatccttcttccgtttatacaggatggagattgcactggttttgtcgggtttgatgcagtaaaggagaggagaaggtattctgatacggaaatttcacttctgaaggtttttgcagagattatttcgaatgttctgtcaagagaagagacagaaaaagcacttcatgagcatgaaaaagtacttgcaattacccaggatattgctcagattgggagctggagtcatgatgcacggtccggtaagcttacctggtcagataagacctgtgaaatctttcaggttgatcctaaaaattgtgcttttacctttgatgcatatcttgagatggtgcatccggatgaccgggaccttgtcgcccggatatataccgagtcccgtgaaaaggggttggaacggcatgaacttgaataccggattattcaaagagaaagccgtgacatcaggtacatctatgaccaggggatccatgaacgtgacagagacgggacgatagtccggtcatatgggatgattcaggatattaccagaagaaaactcgctgaaactgctctggaagagtcaaacaggaaattgcgcatcctcaccagattgaccagagatgatgtcagttccatgctcagagaaataagacagtacctggacctggcaaaagaggagcatgatacacaaaagatttccaggtatctgcaaatggcacgggatatgagctccattatagaaaagactttagattttaccagggactatgaattatcaggggtatcatactccggatggttgaacctgtttcagaccatatcgaccttaatacatgctcttgcttcgcatcaggttgtgattgaaaacactgtttcgccggtgctggagatttatgctgacccgatgatgagaaatgtattcatgattattctggagtatgctctcaaaaaggaccggggagtctccaggctgcggatctctgtcaccatgtcaggaagaacactgatccttatctgtgaagataacggggccggtatcccggcggatgagaaagaaatcatatttatgcatgggaattcgaaatattcagacaccagactcttcctggtgagggagattctgggtatcaccggtcttccgatcagagaatgtggagacccggaaaaaggtgtacgggttgagatctcttttcctgaaggcaggtaccgcacatgatcgaatcagaaaagataataggaatcataccctaaatatatttgatatgcacaattttactctctttcgggaaagaggagaaaatatcctatcaggcattcggccttttcacaatatgcatttcagaattgctaaaaagggccgatacacaatacatcgcatcgtctcgtgatcacaggcccggtatcctctccgaaatccatggatattagaaacggcatcaatacaaaactctctcttattgtcgtaatacttctgttcttccttattatccaggtcgtgggaattttcgcaatgtacgacgaatcaaaacggagtgcattgcaatcctcatggcatgagatggagaatcttgcaacccttattgcaagccagatggaccctgatgcattagcagagatcaaggagggtgatgagaatactaccaggtacaagaagatgattgccgatctctgggagatgcagaataaacatagcgatatcaggtttgtctacactcttaccagaaagggggataaactggcgtttcttaccgatagcgaatatggccataatgattttaccgaaccacttattggatatatctatgaagatgctcccccggaagcatttgccgggtttgaaaaggtcagtttgagaaagacctactattcagatgaatggggcacgtatatgtctgcctttgccccgattaaaaatgctaccggccatacggttgccatcgtcggggttgatatctctcgggaagtcattgagaaccggatgagatccgtcgtgaataccgggtatttgatccttattgccacaactatcatatcacttcttctgatcatgctcatcatctatggaatccggattatcagttcttatcagaagaaactggagaagagtgagcatgatattcagatggctcttgatattgctgaggaaggtatctgggagtatgatatgagggaagattcacttcatatcggcggaggattttggaagagccttggacgggacaatccgggatgggatcattcaatccccatagataaggtattctcttatatccatcctgatgacctggagaagtttaaagccatgattcaggacatacggaacgaatcaggtccggatagaatcatgagtccgatacggtttagggcgaaagacggaacataccgatggctcagggtcaccggaaaggtggtgtcatgggaaggtaatgttcctctgaagggtatgggaacgaccgtggatatcaccgatatcaggcaataccaggaagatattgagagaatgtatgagaaactcgtcatcttcgattctatcaccaggcatgatattgccaataaaaattcgataatatctcttgcatccgaagaattggctttatcagaaccaggtagtgatgagcagaagaaatggctttctgaaataatgaaggcaagtgacgggatttctgcacagatacgatttgccagttcctaccagagcctggggagtggaaagccacggtggaatgatatcgatgagataattacatcgctcatcgaagatgaacaccactctgccatttcagtaatgaatgagtgtcagggtctctttttgtatgcagatccgttaatcaaccgggcactttataatctgtttgagaatactctgcgtcacgctggtctggatatcacatatatcagattctggtaccgtatagaggatggaacctgcattctgagtatcgaagatgacgggagaggagttccggagagtaggaaagaggacatttttacacgtggtgtcggagagaatacggggcttgggttatacctgattcgggagatacttcggattaccggacttaccatacgggagacaggagagttcggacagggtgcacggtttgaaataaccgccaagtcagggttattcagagtggagcagcaatcataatccagtcttcccatttattctgaatttccctgccggcaccgttatctcaaatcttgctccttttccttcttctccgcattcacagatagaaagatcggtgatcgataatatctcacgggagaggaagaggccgattccggtatgtttgccaaacccatgatcaaaaatatgttccttatcagaaccagatatgccaatcccgtcatcctcacagatgatgatacaggccccttccctgatctcttctgcaaaccggatatatgagagggtctttccatgacggattgcattttcaatcagggtggagaatactttccgaatgataggatctgcaaatatctcaagagtgggagatatcagggattcaatactgacatctgtaagagggatctcagaccgggcagatctgacaagcgacgatacattcacccagccggatgagacgataccaaagttttcatactctctggtaaacccgatagtatcctccatccgttctccagcttccttgcacagggaaagataatatcgtgccttttctggatcatcttcagagtttgcaagatctaaaaactcatttacagaactgataaggtttaaaatatcatgcctggtcagacttgtcaggaggcggagcttcttgtttgactgcaccaaagcatcctgcatcttttttctctcggtaatatcacgtgaaatgccaagaattccagtgggtctgccttgttcgtccctgagaagagtagccgaattttcaactatgatgactgatccatccttgcagtactcctcagtatcaaaagatatggtccggttgggatctgcagttcctgccagttctgcctccatctcatcatgaaaaagtttgagtaccttttctactgaagcgggtgtcatcatatcagttatggattgtgccagggtctcttctaccgtaaaccctttcattttccaaaccgaggggcttgaatactgcatcttcaggtccatgtcaattatccagatattatcggccgtattctctgcgatcagacgatatttctcctgactctcatgaagggctgcctcagccagtttctgatccgttatatccatgatattaccaatgaccctgatcaccttcccgtcagccagtaccggctcagcagttgtccgtatccagattcttcttcctttcatcgttgtgaatggaaaaaccaggtcatagggcactccttctgtgacacaccgttcaaaggcagcctggataaccgggcggtcttcaggatcatagcagctgatactttttgttatatgctccggcgatccgggcgtaatgctgcccgggtctatatcatgtatctggtaggtctcggtggtccaggtcattgtctgtctttggacatgccattcccatccacctatccgggtcagtttctgggttgcatcaaggagatcccggctctcctgtaatgtttcttctgcctctttccgcttcgtgatatcttcaaatattacacaaaaccggcgggtatcattccatggccggtatacatgacagtggtaggccttattcgtgggtgcatggaagagatcaaactcactgggtatacctgttacggcgacctcaccatatcgctgaatccattcatcctcggtgtcaggccagacttcatgaaccgtcttcccatacacatcatggaacctgacgccagtgatgttttcatatgctcgattgatatacaggaaccggtaacttataaatctcccgtcatcgtcaaaaaccgattcgaacataacaaatgcattgatcatactttcaagaagccaccagtattcctgttcgcttctcttgagatcatcctcgatcatcttccggtttgttatgtcaatgagaaacccttcaatcccggtaatctcaccattttccataaccggaatggcagaaaaggaatgaatccctgtagtaccatccctgcaccgccgggtaaactcacctgaaggaatcggctcacctgagagtaacctctcaaaattcttctgggctgcctcctgactggtatctacctgggttatagagaaatgatgtccaataacctctgatctatcatggtaccgatgcatcatcagccaggcatcgtttacttcctgataatttccattccggtcgatacggaaatatcctgcgggagaattctgaataatcgctgaaagacgtctctcccggtcctccagatcagcatgtaaccgtttctgatcaagcagagaccgggcaagggtaatattgctgtaacttaaccgggagatcagagaggagaaccgggtataaaagtccatgatggttgtaactgtgcttttgctccaccggggaacccggtccagtgctgccaggtattcatctttatcaaatccgaatctttcagcctgtgcagaaaatacgtcccgatccggcacctcgtcatcaaagaagaactgtcccaggaagagatttcccatgtgccggttcccgataataatgggagtgaccatatcccacatattgtttttgcacttgtacacaaggtattctcccgctttcacattccgggtgagataaagatcactttcaatacagtttttacaactctcctcatgcacccggtgaaattttgtacagatgtcctgccagcctgtagcgaccaggatattgcctttcaaatcaaggatggcgatccctatatgagtcagggcgtaaaaatcgtccatgagtatctggagctcatgactgtcgataatattggcaaattcctcttcgctgatgtcatgctccggagtgagaattgtctccagttttaaccggagctctttctcccgttcaagaattttctgacgacttatctccagttcctcatagttatggcgaagttcttcttcagatgagcggatctcctcatatgccgatgagagtgcttcattctgccttgaaatttcttcttctgcacgctttctccgtattatctcccaggtcatcgtgcccagagtctgcagggcatcaatatcatcatcacggtaatctgattctttattggcaaccgctaatattgcgacgatccggtcaccatcaaagaccggcatccctaggaaccgggtaatgtcaatatgaccctcgggatatccatgctttgcatgatgaggaagagagtaatcatttatcagacatgacgtccggttccggatacattctccccatattcctgctttatcgatgggaaaatgaaggggtttatccctgacctgacacatatccatggctccctccgaccaggaatggatgatcatctccgattcatcagcagagagggtcccgatgaatgcatacaggcttttcgtgatgtaaaggctctgtttgagtgaataattgaggatatccatctcggaggcatcaaccatcctgagcagggtcaggaatgtctggagacgaagcatgtgcagtttattctcctcatcagacctgatacgatcactacagtcgtgaaataccccaaggagggttttctggccgtcaagttccaggagtgaactgttgatatctgcaaaaaatatactcccgtcctttctttgaaccgggatgttcgaaacaaaatggagaacccctgatcgcatcttttcaaactctgacatgacagaggggagagcatagacaggatgaatctctgcggttgtatgtccgataaggtcttcacgggtcgtgccaagcatccggctcattgcttcatttacgaatacgaacctcttcgtcttgacatcagcaacgattatcccgtcagggatgttatcaaaaaccatcctgattcgttcttctgcttttttataagcttcctcactctttttcaggtcggtgatgtctgttgcaatctcaagtctgaccagtcggccatcagaccacctgatagcccgatctctacagtcataccatcgcccggtctttggatcatgaaattcccaccggcagactccggttggtttctggttggagaggaggaggtgattggtgcaatacgggcatgggccttcagaatgggcacggatatgggaatagcatttttgtccgtgtacattaccaaaaagagcccgtccccgttcattcatgtagagaatgtcataggtctccatatccgcgacatagacgaatgcatcaatgctgtcaaggatagcatagagttgagcctggatctcctcaatgaagagattttgagacgacacgaccggcagaatatgctcctgacctgagggtgtagagagacgggtatcgaagtcgggttgggcctctgatagtaccggtttgaaatcaggcgttattttatcctgttttcgaagatagttcagaatcttctcagaggagacccattccttatccagggtatttaccatcgcatctatccgcatcacttcagcatggatgtttttggcgatgtcatcatcatctgccatatctgcataggttgagatgatggtcagggggtttctgatcccatcgttcagaatggcaagttttgcaatgttctcctggatcttattcatcgcctgttgtttctctttctccaggagtttttccccggtgatatccctgccttgtgctatggttgcaatgggactcttcccgtcagcggcataaatggttgcagaattccatataaccacccgaattgttccgtcggcatgaagaattggtatctcaactgtctcccacctgactccgtcacgggttgtctggatgagccgcatggcatattctgcatctctttcaggaaagagaatgtcaagcggttttcctatgacctcatcacgtggtcttccgatgagaatttcaaacgaatgattgattcggcttataataccttcaggatcccatacgataatcggaacatttgaatatacaaacaggttttcaagatatgcattaagctcattcagactgttctcacgtctcctccgttccgtgatgtcctgaaagagggtgacgaattggccgatctgtggagcatatgcaaagacttcaaagtatttttgaagctcgcggctgaactgctcaaaatgggcaggtttaccggtcagtgcgaccctcccgtatatatctatccagtacggctcagtgtcagggaggacctcaagaaccgtcttattacggatctcatccccaacaagtccggttatctgttcaaaagccgggtttacatcaagaaaccggtaatcaaccggagcaccggactcattgcagatgatctcatgtaccgcggtcccaacgatattttcttcaaagagtttgcgatacttctcctcgctttccgatatcttctcatgagcggcccgaatctcttcgagctggtgggtcagtttctcctctgcatttgttaaccggtcaagtgctgcagtcagatcggcattctttttggtaagacgccattctgaattcttcttctcggtgatatcctgggttataccgacgatccgtctgccagtgcctggatcatcctcctcaacacttgctatcgaaagaaggattctgggggctgtattattgactggaatgatggagtattctatatgaaaatccgccctggtttcgataagattgcgaaatgccttttcaaccttatcctgctcacggatacaggcaaaaatatcagatatcaaaacatttcgggaaggcccgtccatcccgtataaccggagtgcttcttcagacatccacaagacatctgaaccgacagcatgttcccagcatcctatctttccaatctcctgggctttcctgagtcgcttctcatttatccgcaataaccgttctgattcacgacgttgtattgcaatattgattttatgggtgagatcggcaaacaacgggcctggggtgccacctttttgcacataataatcaaccccgtgttcaatcgcctcaataacgacctcttctcttcccttcccggtgaagagaatgaatggtatatctccaatatctgaccggattatttttaataactcaatacctgtcattccaggcatgtgataatcagatatgacagcatcatatcttcctgcccgtaacttttccagggcttctctgcctgataaggctttatctacttcaaatccggaatgtgttaaaaagcggacggatgcatcggcaaccaggggttcatcatcgatatagagtatggtggtcatatgtatgggggaacgatgcgactttggcatacatgaatctgtcagaatttaatactgattctctcattcggacctcagtcatagagcaggatcgcgtaatatgcaaaccagtctgcaccacacagaaaggattgccgatgattcattcagttttcctgcaggcactctggtaattcaggcattttttcgacgctttctatgctcactccatagccctatagtataacataggatggttggcatataaaagaacctgatttcgtggtagtgatacatgagtccgggaacgataccatcagtatctttgcctttatgtatcaccatgaaaaccgatcttgtcggctatgagaaaaatgagattcaggactactcctacaagagtcgcaagggacattccttccaggtttgcaggacccaggtcgatcatggtgcctgatacaccgattatcaaaattaccgataccaataccatatttctcccatgtgagagatctatccctgcgttcagaagcatctgaatcccctgtgctgcaattactccaaataggatgagtgatactcctccgataaccggttcaggaatgcatctgattgccactgaaaccttcccacagaaagaaaacaaaattgccaggacggcagcaccgccaaatatcgcagtactaaatacacgggtaattgccagtactccgatattttctgaataggtagtattaggggtcgcaccgaaaaatccagataaaatagaagataccccttttccaataagcattctgggcagacccggctctttgaacagatccttgccaatgatagtccccgtcacctgcacatgaccaaataattccaccagggtgacaaaggatgcaggaatgatgataataattgcatgagcagaccataccggaaaataaagtgttggaatagaaaaccagggtgcattcagaattggttccagggagaacgaaccggtaagagcagcaagggtagtccctgcgacaataccagacaggataggaaggatcttgagaacacctctgaataatgtcatacaaattatggtaaacagcagggtgaacaaggagatagcaacataatgcaggtcaggattgtcaccggccaggcctgcataccgtgctgctgtaggggcaagaccaagtcctatgatagttaccacagaacccataaccacatcaggaaagatgagtcgtacccatccggaacctgcacggtagataatgagagcgacgataaggaaaaatactccggatgcaatatatccggttagtgctgcaccatatccatatgacccgattatcataagggatggtgcaatatatacgaaactggacccaagataggcaggaaccttccactggcagataaccagaaaaatgagagtcccaattccattaaagaggagagtcgttgccggatcaatgcccagaaggatcgggacgaggatcgtcgctccaaacaggcacacaaatgctgcagacttaaagggaggaaggtggagagtggcggtataacatcaacagggatgggatctgaattcattatatttcaatttcggaatatcggatgtttttaccctttctcccgagtgggagtgtggattgtttcaggcgatcagccattactctccggtggggtgcatggtccggtataccccttttggcacaataatctcaaacaccgctccggacccgaaattcccggtttcacgaatgctcatcccggtaatctgaagtacttcacggacaaggaaaagcccaaagccattgttttttccaaacccacgctcaaaaatctgttctttttgatcaaatggaatgccagccccgttatcctcccacctgataatgagggagtcttcctccagatgggttgtgagcatgatcctggttacccgctccccatgtcggagagaattatcaagaaggttactgaatacctggctgaacatgggatctgcatagacttcatagtcgccggtcattgatgtatactcaacgttaatcgggattgataaccggagggtttccagccgggaccactgaggttcgtgagtgcccagattcggatatacccgggtaaactcaatctggctttttattgcctgtgttgctgatctgataacatcgatctgatggagtacggaagggtccgaaatatccatctcggcagctcccagcgagttaaagatgaccgtggttttattgatgatatcatgccgggtaatgctggacagaagattaatctgacggtttgcatgccgaagggcttcctctgccttcttccgctcagagatatcaagcatggcaccaatcatccggatggcaacgccccctggatttcgaaggatgcagccccggtccatcacatatgcatatacaccgtcagatctcctaaatctatactcatcatgccagtttgtgcaagtggggtcttccagtgctgtatcaaatccttctgcaacccgctcccgatcttccggatgaacccggtcagtccaccatgccgcggtttgatcagaaaatacaatatccgaccacccgaatacctctatcccgacctcattccagcgttgtgcatcgtttatgacgtcaaaatcccagatgacatcattggttgcctgtaatgccagacgatatcgttcttcctgctggtacagtttcttctctaccttctttcgctcagtgatatcccgtgctgtagtaaatactccggcaatctcacccatttcattcaggtagacagaggcattgtagagcacatcaataattgccccatcttttttccggattgcaagaggataatcacggacctcacctttttcaaacaccatcagatacccggccctggcttcttcaggttcggtaaagtattctgaaaaatcagtacccacgagttcacttctggtatatccggataccgtttcggttgccgtgttgacatccgtgatcttcccgtcccttccgatcgttatcagagggtcaggactggtttcaatcaaagtccggtggtatctgcttgcctgtatcagttcatctcttgcccggccacgacaatcgtaccatctgccggtttttggatggataaattcccctttcatgagcccagttggatccgtcttctccagtatgaacttatttgtgcaaaaggaacaggggctatcagcattatcatacatacaggtgtgacatttctggccaatgacattcccaaagatatttctcccttcttcattgatgtacaaaatatcataggagtctaaatctgaaacaaagatatacgcatcaacactatcgaggatagagtagagtctggcctgaatctcctcaatatagcgttcatacccgctgacctggggggatgaaataacctgctccggtcggtcagggggtggtgcttccgatgggactggtgaaccgggagaataactgggaacaaaatcaaaggccaccatatcatggtttctcagataatccagaatcttccctgaatgaacccactcacggtcaagatttgtgaccatctcatcgattctttttacttcgttctggatttgagcagttatccgaacatcttcgctcatatccgcatagatggagatgagggtaagagggtttctgataccgtcattcaggatggcaagctgggcaatgttttcctggatctgtactgctgcacgctctttttcccgctcaaggaatcgttcggcagttacatcacgtccctgggcaatcgtcgcaaccgggtttttcccgtcagaatcatagatagtagcagaattccagagtaccgtgcgaagcgtaccatcctggtggataattggtatctcaaccgtctcccaccgaaccccctcaccagtcttctggataaactgcattgacctttctgcctcatcttggggaaaaagagaggataggtgcctccctaccagatgtccggcgggtattccggtgaggatctcaaaggcatgattaaccctggtgatggaaaacccggtatcccagatgatgatcgggacatttgcatgggtgatgaggttttccagataggcgtttgtctctaaaagctggtactcctgctgttttctttcagtgacatcccgtataatgcggacaagacgttcaggttctggcgaatatgcagtcccttcatagtatctgccaagcttacggttgaaatattcaaaatggatcttcttttccattgctgttacatcactacaggtctcaatccagtcatcttcattaccgggaaatacctcacggaccgtttttccgataatatcagatgccttcagaccggtcatctgttcatatgcaggatttacattaatgaaccggtaatcaatcgcttttccggtactgtcacagatgacttcatgaagagcaatccctgcatcattggcatcaaataatcgtctgaactttttttcactcaccatgagatctgaagtctgttcagaatatcgggatgaaagccaggtcaccactccggcgactagtataaatatggcaatacgggccaaagcagaatagacctctgactggtggggcccatatacggcgatgagaaggccgtataccccgatgagaaccagtgagaagatgaaccctcgccggaggtaaaatgcacaggcgataattatcgggaagtaatagaggttttgaaagacgatggttatcccataggtaagcgacacaatgctcagcatgatcacaaaaagagacgtgaaaaaaagtgaatagagaggtattttggggtgaagattaagtgattcatgaagaagcattctatcgggccctatgtatcagatagtactgatatagaatccttatatagcccgtgtgggataactatttcggattgtgcccctgctctatcatcccaatatcaaagaaccagatcgcccttcacttctccaaagaagaacatgacagtggttgccgtcttttgactcttcctgtctgcgaggttcccgctttcatcaggatggatattccggagaatggaggagtgtatgggggaggcaaggttaaagatgtgggcgctgtaagtccattgatggggggggaaaattagtatcctctccaaacctactattacatgggagggacatatgacagccacaataaccggaagattgacaagttcaaaaacaatccaattagattctcctctgattactgatgagacagaaattttgataaaattaaaaaagacatatcccagaaaaaaaatcattgttcccgaatcttatgtcctggaaatagcagatactgatatcgaagagttatattgatgcttttctccgatattgtggattgttccgtatttattgatacaaatatcctgatttatgcacatacgaatacccggtttacacctgcttgtgaatatataaatgacaaaaactgatgtgaatataagagaatagaggagtattttgagaggatattgaatgatttatgaaggagcatggtatcggctctaggtatcgggaagtacggatattgaatccttatataacccgtgtgggataactatttcgaattgtaccccggccccgggagtgccggtttcccgaatggtaaagccgcctgcagatacgatctcccgtgccaggtacaggccaagaccggtatgctccccgtacccgtgatcaaaaatcatttctttttttgcaggatctattccgatcccatcatccctatagaaaagaaccagatcaccgtttacttctcgggagtggaacgtcccctttgttaccgtctttccatgtctgatagaattatcaataaacgttgaaaagaccttttgcaggataggatctgcaaatactttcagagatggaagaatggtattttcaattttaataatatctgtgggtacctctgcctgagcagattcaataagcgaatacacagatatccatgcagaattggccatcccaagcccttcatactcacgggtaaatccgatgatcgattctatccgatttgaaatttcatgggcctttgaaatataatcgtacacggcagacagctcctgtgtttcaagggctatctcctggtatcctttcagcatcagcaggttattgacgatatcatgccgggtcaagctggtcaggagacggattttattatttgactgacgtaaggcatctttgacccgtctccggtcggtcacgtcggtaatgaatccctcgaggaataaaagccggtcatcttcggaaaatataccccgtccccgctcccagacccatcggatttcaccggactttgtaatgatagggtattcaacctcgaacatccccccgttatacagaaatttctggacagtctcccacaacgtctgctggtaatcagggtggaccaggtcattatatgagataaggttgttgtgaatcaggtcagcaggagcatacccggtaacggcaatacatccgtcactgataaattccatagtatagtcagcatcattggcacacctatatacaaatcccggtagattgcttatcatcgtggcatgggcacgttcactctccacaagagcttgctcaacgacctttttatcggtgatatcacggattataccttctacaccagcaatcgctcctgactcatcatgataataatgactggaggttgacacataaacaggagatccgtcctttttccgaagacgggtttcataattccggacaaacccattcgtgcataatgaatgaagaaattcatctctatcatccgggttgaaatagagggtttcagcgatgggttttccaaggatctcatctatggaatcatatccaagtagggtcgcaccactcggacttaccataatgagcgctccttcagggtttgaccggtaatagacatcctggatattctctatcacactccggtagagtgcctcactcttttctagtgaccggatagcacacttcttctgggtgatgtcaagcagagaggcgatgcttctttttttgtttggaattaccccgatagtaaggtatatttctcggatttctccggaacgggtgataaatctgaactcataatggggaagggcacgtgattcatcttccatcctttttcggttttcaatcctcatccaggagagatcatctggatggacaaaatcaacccatctcatcttcccttcgatctcctccctggtatacccgctcatggaggcaaaagtattattagcaaggctgatgatcccgtcctcttcaagaactacagtcgctgtgccagtattttgaaaaaccgtccgatatgattcctcactttcatgaagggcctcttcacttctccggaggtcatcaagattctgccggagttcttcttcggtcgcaacgatctcttcatacgcagcatggagttcttcagctttagttcggagttcctcctctacctgcctctgctgaaccgcctgacggattttatgataaagctcagtaaactgtggttttggatccccgcctttctgcaggtaaaaatctgccccttcatttaaggcctggataaccacttcttcacgacccctgccggtaaagaggataaaagggagctggtttccagatgtccggacagtttttaaaaactcaatcccgttcatctccggcatttcgtagtctgatatgatcgcatcataggggttggaattcaattttttcagggcctgcggggctgagcttacggtgtcaacagaacactgacctgtgcgttcaagaaacatttttcctaactcaaggagtgttggctcatcatccacatagagtatctttgtcactgctttcccccttccttataatgcatcctccatattccaaacggaatggtaatttcaaacctggcaccagtccccggctggccggtctcccggatggagataccggtaacagaaaggatctcacgaatgaaaaacaacccaagaccggtatttttcccataccctctctcaaagatctgttctttctcctcatatgaaataccggccccgtcatcttcaaacaggatcacagcttcatcttcatgtatctggcttgaaatctgaatccgggtgacgccttggccatgccgtattgaattatcaaccagattttcaaagaccttgacaaccaggggatctgcgtaaagctcaatatcatcagcagtattgacgatatgaacagagaacctcgagaagacagcctgaataagagatgagagacgatgccaaaccggttcatgagatcccagatcctgatatacccttgtaaattctatgtgagactgaataagcgagatcgcgtggtcaatatgcttgaaatcttgatctgccggagtagtatccacctttgattttgcgatctccaaaaagagctgcaccgcattgaccgtattgagtatatcatgccgggtaatcccagagagcatgttcaattgacggtttgcctgacgaagagcatattcaactgttttctgttcggtgatatccgttgctatctcaagacggacaattctgccatctatccacctgatggcactatcccggcattgataccaccgtttggtgatcatatttttaaattcccacgttattgtcctggtgggattgcccgcttcatccagaagcaggtgatttgtgcagaaactacatggctggtcaaaacctttctgaagtgactgataacagatcttgccaatcacatctccccatatccgctttccgtactgatttatgaacaatatctcatgggtttgcatatcagcaacatacaccagggcatcaacactgtccatcacggtttttaaggtatcatgagccttccggagggcatcttcggtttgttttcggtaggttatgtcacggatggactcaatcgccccggctaaccagcctgatttatcaaagagcggggatgcaatactccagagaatgacatcatttccttgaaaattagtgataatcgattctgatatgaccttgccttcatcgtttttaaaatctgcatataatggggatatggtatcatcataccgcatcgcgaggtcaataaggatgggccttcgttccagatagaacgggagagagtattcataattcccctttccgataatatcagatgcctgaacgcctgtcatcttctcaattgctttattccatgcgatgactgttccttccttatcaatcacaaaggttgcatcggggagaaattcgatgatgtcatggagccgttgttctgaccgtgcaagggcatcttctgtacgtttccgctctgtgatatctatcgcgatatggattgccccggttactattccgttttcgataaccggattgcttctgaccagaaaatagtgcccgtcaggagttgtcacttccccttcctgaaatgttccggtctttattgcctgcaatgccgtacagccaggacaggggctgtctcttccctgaacaaaccggtaacaggcaccgggaaaattctggccaggtaacccgtaccggtcacatgtcgcctgattcacccaaacgacatttaaatcacggtcaacatattcaactaatatatccctcagcccggatagtattgcttccctgatcttctcgttatgtttcctctctgaaatatcacgggagattgccagggcaacttcctggttgtgtaatgtgaaaagatggactgatacctcaaccggaagtactgaaccgtcttttcgttgatgcgtacactcaaaagtaagatgtctctttgcaaacagggcaggggtgagccttggaatgagttcgttactctcattagtattgatatcgataacctgcagagaaagaaattcttcccgtgtatacccgagcgtgctacaggcggcatcattcacttcaagtatcttcccaggtttcccgttcggacctatttcatggagaattatcatatctgatgcattgttgaagagctggcgaaaccgctcctcgctctccataagtgctttctctgctttttttctctcggtaatatcctgcattgtcccatgcagtccggtgagcattcctgttgcatcatagaccggccctccggttgcccgtacccatacccgggttttatcaggacggatgagttcgagttcaaggtcatatggtttcccggtctcaatggcaaaggtcacagctgcctgcagtctaccccagctctccggtacatacaaatctgacagacgggaataatcggggggagggaggtcaggattccagccaattatctgacagagctcatctgaccagaagatccgatctttatgcatatcccagtcccagataccaatacatgcctgtcggtgaatctcacggagttgtttctgtgccttttgcaggtcatgttcagcctgcttcttctcagtgatatcgtgtaaaattgagttgcacaggacaatttgaccggaatcatcccgaatggcatccatagtaagatgtacccaccggtgcgttttatcagccctgcagataatcagttcccgctcggtatgcaccccctctttcagaaatctatcaaatatctcaataaaccggcttttgccttcaggaaggtcggcatagatatccagagaggaagtcccgatgagggtatcaggagagcatccgagaagttctcctgcctttgtattacatctgacaatagtactagaccggtcaatagaaagaaatgccaaaggagattcattatataactggcggtactctgcttcactctgaagaagtgctttttcagctcgttttttcttcacgacggtggtaatcttatgactaagttctgtaaactgtgaccgaatctctccccctttctgcacgtacccgtctgctccgttatctatggacgcaatgacaacctcttctctcccttttccggtaaacatgatgaatgggatatcatttccggaggaacgtatttcttgtaacagatcaagaccactcatcccatccatctcataatcggcaattattgcatcatacttgcgttctgccatacacgcaagggctttttggccggaaagggcagtatcgacatgaaacgaaaagaaagcagacagatactggcgggtggcctgaaggaccacctcgtcatcgtcaataatgaggagacgaagaggatcagaagaaaattcagaaggatcatcggtcatagagatacacagtcagggtattacaatatacgatctgataggatatgaaccagtcaatacgcccggcataaggtacctggaaagggactcaaacatgctcaaatactccggtttcaagtgacagagagagaactgcatcaatgttattctctccgaattgtatcggtacagaacgattgaaaaagcaatattcctgcccccgtagagtaactttcatccgtttcgagtcaggttttttagaatcaataattctttgatagtatgaaaggagcgaaataacctcttcttcagggaaaagatcaaacaacgtcatattctccctctccagtgattctgaaccggtcatatatgtacatgcacaggaatttgcatacagaatggtgccattccggtcaactacgcaaacagcatcgataagtccgtcaagtatttttttcaactggttttcctgaagaatcaccttctttttctcccgcgaactctcagttacatcacgaaacagcacaataattccggtgatggtcccatgctctttcatatcactgatggagacgtctatgattcgttcctcaccgtcacccctgatgatcggaatttcacctcgataatgtccggtcatagttatttctcggtaaattttttccccaatcttttcaaactcttcatctgaacggtagatcattctgatactctgaccggtgaggatactcttttcataccccagaatcctgcatcctgcagcattacaacttacaaaccgtctgtcattatcgagggtaagaattccgtcgtttgcatcttcaaggattgtcgtaagatatacatttaaatcatgaatgatctgctcagcagtaacacgatcagtaatatcgacaacagttcccaggtatccggttacctcaccatcatcattccttaatggaactgccattcccagaacatgaacctcttctccactctttttctggtaccggtatgcatgattccagggtattccctcggcgacatgttcataccagagtcctttgatccagtcccgttcagtatggtgaatcactttcacccatttcgatccttttacttcgtctggctcatacccggttatctcacaccatttttgatttacatagatgactttgccttttgcatctgcctcaaaaattccaacaggagcgacttctgcaagagtttcataccggtgaagacttgaagaaagctcacgggtttgtatattcagacgctcttccagctcttcctcgtattttttatgtaatgtcaggtcatgcagaaccagggctacttttgttgagaaatcattctcctgaatggggatacaggaaacacggaagaagcactcttttccttccatacccacataatcttcaaagattcgtttatttcccgctactgcatcttccagtgccctgattatatcatatgaaaacaattcagggatcccggtataccggatattcgaccccctcacctcatctggctgaacgttgaagaatgaagcacatggatcatttacatcttcaacaaataggtcttcatcgacaatcagaaacagatcagaggacaggcttaagagtcgcgcaacaggaattcgcgaagaaagagtgtacacttttgcccttccaaaggatctcatggagatctctcctctgccggtcatgagattgaggatattcaggattaatgtccggttaatcccgagagatctggaaatatcagatattgtcatgccctggcgatttttagccagtatttgctgaatttcacgtatgatcgcctcctcggttttattttgattatcatcgtgagttttcatcaatgcagcattcattgttttcatagtatgaataattaatgcttagatatattttgatattaattatagcaatacagcatacctatatatataataagatcattttaccattatcgagggtttcatacacgtatggggagaccttcgttatcggtgatacaatccatttcaactgttccatatggggtgaatcatggaatttttggataatttaaaaatgagcaggaaactgatgggcagttttcttgtcttaatagccattctcattatcattgcccttgctggccttctgaatatgatgacaataaatgacgggatgacagcaatgtactatgaccgtctcattcctttgtcacaaattgcttcagtaagtgatgaagtactcgctatgaggggagataccatcaaatatgcactgatacccgaagaaagagcaaatatcaaaaatgctcttgaaacgaatcagaaagaagcagaggccctgatttcggagtataaaaagagtacattacttgagagtgagagggcagaacttacgaaatttgaccagtattggaactcatatattgcagaaattcagaaggtgattgaacttgccgacaagggatctgaccttgaggtaaaaaaatccatccagacaggaggggctctcgcagaatccagaaaaccagtggaagaagcgattgccaatctgtaccagattaatctgaaagaatctgagaagataaataccaatgccgatgcaacctttgcacagtcggttttgcttattgcaataatatccatcgttggtatcatcatctcaatcattctcgggattctgatcacccggagtattactattccctgtgtaaaagtcaaatacctgctcaatgagatgagtatgggtcacctttcagaccggctgaatcttacgagaaaggatgaactgggagatatggccaggacgatggacagtttttctgatgatctccagcacaaggcaattgatgttattcaccggattgctgagggagaacgggtcgagctggcgacggtgaaggatgaaagggacgagatcggttcagcattacagactcttgtgttcgcactccgggggctgacagatgagacgacgaaactcatcaacgctgcaaaaagtggagatctctctgcccgtggcgatgatacgaagtttaaagggcgtttcagggagattattgcaggcattaatgaaacactcgaatcggttgttattccggtaaaagaagccatgcgactctcaaaagaattttctgaagggaattttgtcgaccgcatggacccgaatatcgcagttgccggtgatttcatcgactttaaggatgctttaaaccacctgggtgaagagacgtcatccgcagtggggagtgtaaaaagtgcagttgagaccatcaccgcaggcatggaagagaccgcatcgagcgttgaggaagttgcaaatagtgtaactttactgactgaaaactccactcatgtcagttcactggcagaaaagagcggagaaggaatccagcagaccttaactgccatggaggatctttcacggaccgtcggatcagttgccaataaagcagagactgcatcagccctggcccagaagaccgtgaatctctccaatgagggtatggaacttgccggaaatgctgagaaaggcatggcaagcatcatgcagtcctttgaaggaactgaaaatatcgtgaatgatatcacaaaccagatggatgaaatcgggcggattgttgatgtcattaccggaatagcagaacagaccggccttcttgccctgaatgctgcaattgaagctgcccgtgcaggcgatgcagggatgggatttgccgtcgttgctgatgaagtaaaatcactggcactggaatcccagaaatctgctgaaaatatagcaaccatcattggaaacttgcagaaaaaatcccttatggtctcagattcgatgaaatcatcctcccatgaagtaaaaacaggaaatgaggcggtagggaaaacccttcaggtgtttgatcagattgtccaggcaatcaatgaggtccaccagaatatgaccgaagttgccggagcagcagaagagcaggcagcagcagtccaggagatcactgcaagtattaccgaggttgaagatatggtcaggcagacggcaaaagaagcggtaaactcagcagcagctaccgaggaggtatcagcctctgttgaacagatcaaccgggttgtgtctgacgcatccattgcccttcaacgaatatcatcagatatgggtaaatttaaggttgcataaaccaccatgggagccggacatatgggaacatatagtgttgaaatatcagccgatgcagtgcaggaggagcagatatcctccgttcctgctcattcatccaattggaacagagtaaaacgggctggaacaatccaggtcgtggaatttattctgggaaaagagatgtttgcaatcgatctctttgatacacgggaggtcattacccagaccgaagtaactccccttcccagtacccctgattatctgaagggaataatagatctcaggggatcgatcacaaccattgtggatctcaaagggctgatgcatatcaccaccgaatcagcgggtaagaaaaattcgcggattatcgtccttgatcggtccattaccagcaaaccaatcgggatcctggtagatgatgtcttctccgtcaccacgtatggacaagaagacatcgaccgcgagaacacctcatccagcgacacgcaccgggacatcatcggagtcatcaggaagagaacaaaaaatgccggtgagaaagataagggcgggcttgttgtctggcttgatatcaggaagatgatcggaaagatagaagaagagttgtaaagagcgtataggatagagagttatattctttttttcatactacccccctgacatcatcaagaaaaaatcaggatttaatagaccggccctctccctcaatgctacaattggaacgttgctcttcaatgaatatcatcagatattggtaaattaaggtgctgtatagaccagctcggaagccggacctatgggaacgaatcgtgttgaattttgataccaacgtactatcatcaaaaacaggaaaaagggattattaaattgggaaaaaagttattttgcttcgtatttcttgatgaccgtagtcagtcgggctattatatccttattgagatcacggactttcctggatgcgatctcgtgtattttcttctgtgaaaggtcggtctcttttccaagctgagtctgtgtcaccttcttcgcttgggtcagtgcattaatccggtctgcaatctcttttgggatttcaataatgtcttcgagagcagattttgatcctgcttttgatgctggctttttcgcggcagtggccgtttttttcgccggagcagaagtctttttatctgaacctgctgatactgcttttgatgacattactgcagtttttactggtgcctttgcttttgatgccaccgatgcgagtgctggtttcccctctgacatcaccagttttttgatctctttcaattcagcatccagggactgaatcatcttttccatcttcaggatctgttttgcctgaagatcaacaaccttctgaaggttattttccgttgctgccggttttgcaaccggtgcctttgatgtagtcttggagctgactggttttttggaagttgtctttttggtagctggttttgtgaccattatgatccccccatgagtctaatgacgtataatagtgtagtttaaattttcttaaacattccggcccctgaatgccggatatcaccaatacatcaatagagacttaccagataatagaacgtgctattttatatttttttagtatcaggataggaatattccttcaattctcaaactcagcatgaacgaaaagagtcagggcaattcatcacgaaattaatagttttgatcaaatgctataaatttcggatattatcaaataatattcataattatccttgtttttttcacaaaaatccaagagagagcagaatgcgtgtttcacatactggataaacattttcaggttttgcaaattccaatctcctgaaatcgagaaatatatggactgtctgaatgagaaacacgaataggtttttttatccaaatttttatgtagatagataccaatatgagatatatgcccctgatacagaataatttcgctttctttttcaaaatattggccctcatgctgatacttgtacctgcttcctgtgtgggctccacggatcctacggttatcataaccggatacaagatatcacctgatgtcattcttccccatgacatcggaactatagaggtgacccttgcaaatacggccatgcaggcatcaaagacgaatactaagcccggcggccaggaagaaatggttgcacagtcaaagacagtcccggtcaatgcctttgttgaatctgcaatactcaagaccaccgactttaccgtattatccggatggtaccaggacatcggggagattggcccaggtcagtcaacaactttgactttccttgtagaggcacctgaccgtgagggactctacttccctgaagtctggattcgggtcagaggagcggagagtgtaaaatatccgatcccggttaatgtaaataccagacataccctcatcaagcaaccatccattcgcctctcacggtctgtacccgtgaacatcactccgggaagtgcctttgatataacacttgatctgcagaatgagggacttgcaacggcccatgatataacggtggagataattactccaaatacctcgctttcatcgcaaagtcctgaacgacagtttatccgtgagctgaaaccaggtgacagcacaaccgtggccctttcatttcagtcagataatgatattcccatcggtatcaggcagattccggtccgcatctcctacctgaatgcagatggtaccaggcttgtgcagaatgaacagatcggggtacttgttcagggaaccggtgaactggggattgcaaaacagatccttgatccagaacagatatttgttggtgatatgttcagcctggtctgcagaatagaaaacaccggaactgacaaggcgaaatcagtcagagcaacgctggatattccgtttgatggtaccaaagaggcatttgtcggaaccatcgggccggataacgatgcaccagcggtattcaccctgaaagcaacacaggccggagacatcccctttcatctgacaattcaatacaaggatgatttcggaattcatgaagaggtaataccacttcatgtctttgttggtgaaaagaacggttcagggatgataatcattctggtactggtggtcctggctggagcaggatttctctactggagacggcagcgtcagccctgatcatgacaggaaatcacctttcagtcgcatttttccttgctatacgctcaattcagcgagggaaccgattcacctttcttctcaccgttgcgatcatgggattggtttttgtaaacctggtattcctgccatctatcatttcaggggttgttgtcaactttaacacccagtccatcaactataattacgggaacctggtcatcgagcctcgagagaatacgctgtatatcaccggtgtggatgaggtcaaacagaagatttcccagatatcagaagtgatcggaacatcacccaggttctctgccggagccacgtataattatcatggaacccagatatccgggcagatagtagggtttaatcccagatatgagcaggaagtgacgctcctgcataccaagctgaaagaaggagaattccttgcagagggagatggcgatagtatccttcttggtgcccagcttgccggcaatattgatgaacggaaagataagaccgattcactcggaggagtcacagccggagattctattctcgtgacctttaataacggggtgaaaagaaccctgaaggtaaaggggattttagataccggttcattcggggttgatcggaacggttttgtgacgctcaaggaagtaaaccaggtatatggtatatctgatactgctacgtcagtgctggtaaaactcagccagaacggggaagaagagcggtataaaaaaatcctcatggagtctggtattgctcaaaagatccggacattccaggagaagggacagggatttgtaaatgatgctatccggagctttgagataattaatgccatctcaaccatggtcagcctggttatcgcaatcgtggtcatcttcattgtgatatttataaataccatcaacaaacgccgtcagatagggattctgaaagctatcgggattaataaaaagatcatcatctattcctacatcattcaggttctgataatcgcaacctgcggtattcttctgggtctggcattaagctcaggccttgttgcttaccttacgatcaatccgcttgtatttcccggaggagcggtgtatccggtggtagaaccaggtcccgtcatccgaagtgtcatcagcctggcactggtatcgctgatatccggatttatcccgtcatggaagaccgcaaatgaacccattcttgatgccatcagggggcagtaatgatagaggtaagtgatgtcacccggatatatcagatggggctggtggaagtcagggctcttcagggagtaaattgtagaatagagagtggagagttcgtcgggatcatggggccctcagggagtggaaaatcaactttgctgcatatcctgggcctgcttgatgaaccaaccgcaggcacggtcactattgacggaataccggtgggaacgctgagtgaagaggagaagagtgatttccggctgaaccgacttggatatgtatttcaggattatgccctggtccctgaactctcggtgcaggagaatgttgttcttcctgccatggcacgggggatttcgccaaatgaatacctgagagagagtgaaaagatcctgcacgaagtggggcttggtcaccggattcatcacaggcagtatgaactctccggcggggagcagcaacgggtcgccatcgcccgggccctgataaaccgcccaagtattctctttgctgatgaaccctgtgccaaccttgactcgaatacatcacggactattcttaatctgttccgtgatctgaatgaaaaattcggacagaccatcatcatggttacccacgaagactggcatgaagagtacatgtgccgggtactctatatgaaggatggacttatcgaggatgagaaagcgtgtaaaatgagaagaagggatggtgtttctgagagtatatcagattatctctgattcaaagtgaataatattgcgggactgtggatcaaatgtgatgcctatcagaaatttcttccggggatcggcgaaatatttctgaacatactccctgttatgaatttgctcaagggctgatgtattttcaggaggtatatcggacactttaaattcaaagatccagataccggttcgtgtttttactgtcagatcaattcgtcctttatttgtcatatcttcagcaattatctcatacccgagacttgcgaaccaggagtacaatatacttgcataaaaaccttcaaatccggacatctgattttttcggtaccattcatagggaatcgaagcgaaaagtgactcgatgagaacttttaactgatcagcgtgtcccccttcaagaatctcatacagtcggacccgggattctgatacagaatatcccagaagagtatcagaaaataagagattcaaggaagttctgacttcaaggttcgggtaccccagaacacaggtaaatcctctcaccggatccgacgaccaggttttgatcgtcaggtaccctgcctgaaagaggagggtttcaagcctgatatgctcaggatcaaatgaaccaagaagatcatctcctgcaatcagcccctcatattcagcaggaaaccggggatgtacggaccatagttttatgagaaaagaaggtgttccagtttcaaaccaatagggtctgaatactttttttgaaaagagaagcaggatatcaaacgggttatacacgtgttccccagtccacgaatatccgtcataccactcacgaacctgttctattgaatatttggaaagccaggaatgaaagatagtggagatatctctttcggtgtatccacaaatcccggagtatgcactgtcaagggtgatatcattcagattattcaggcctgagaagataccggtctttacaaatttggagacaccggttaacatgacaaacttcaaataaggatcgagagattttaataccccataaaaatctttgagaatgtcccgcatcccgattgcagtctggacatcctctacggtatcgagtattggcttgtcatattcatcgatgaggatgacaaccttttctccggctgattcatgtattgatctgacaatatgcgagaaatttccagacaatgacccttcagaagcggtacagtcccacttttttccccattcatctatgatctcctgaatccctgctctgagttcatcaggggttctgacaggaaatgcagaccagtctattcgaaggacaggatatatacgggtccaatcccacccggaattcggatcatcaaggaacaacccattaaagagtttctttcgtccggaaaaggcacaatcaagggtgtcaatgaagagactctttccaaaccgccggggccgtgataagaaataatatgacccgttctttacaagggaggcaatgaaaggagtcttatccacatatgcaaacccttcggtcctcatcttctcaaatgactggataccgatagggagtttttggacctgtgcagatgaattcacggggtgacctcccggttatgcacacaccgatcacctgcgaagacaaggacccatcgtttcacctttttctgatatgcccattctggtgacgatccataccgtgtcatctgctctattccatctttcaatgccttgtttattgcctctggtgaactctgacctgattttatatattttaactcaaaaagagcatagtaatccggatgccagggctcccgtggtaggaacgcaatatcgatatatccacctgaaatttcatattctgattttaccaggtacagagtactcatatgggcataggcgaatatgagaattttcaggtatttttcatcaaagccgatatagtcacgattggaaaaagcatggagaacctcttcaacaagggaaaccagtttatcacacttcccggagtaagctatctgataaatggcatctgcaattacgctgctttgtacatccaatccagcttctcgtgagatcatctgcatcatgaaatcatgatacaggccatgtatgacataatttggagtctttacctgcactctgccgggtagtgactcctggattgtcaatagcccgaggtaaaagagaagcgagatgaaatcatcttcagaaaaagagatatcaagagtaaaggtctcggtgaggtttgctgaaacaaagccgtcactggttatcctggacaggactgaaaaattctgatcaggagtttttatccgcatcagtttttcaaacttgctatagtcactaataatattcgaatcaagaagtttttccgggggcttttgccggtcaagacaacttgtaagataatagaggaccatatcactattgaacagacgggcagtacaatcttcactgaaacaatacccatcataatactcccggagggtctcgatcatcccgggaaagatgatctcttcaggaagtgcctcatgaatgagcatgtcaacttctgactcagtaaatcccatcatctcatggagtctcgggcttcgggtcaggtcccgtgcggtactaaatccactggtaagactgtcaagcgttatcggagatacaccggttgcgaaaatcctgccaactattgtcttagtcgcctctttcaatacctcaaaccatttcctgataaaaccattcccgccaaggctctggtgaaagagctgtatgtcaaatccaaggagttcattcgcaaaatgatcatactcatcaatgatgacatatatctgtccatcaattctggtaaataccagggagaaaaattctgccaaaacgtcagcaggagatgaatggctatgaagagttatgggaatattatattttgcaagaaacagattcagatagttttggattttacgactgaaactctccacaagttcttcttctgtggtagttgatattccggagaaatcaaaattcaatacgtagtatgatccttttttcggagttggttccttccagatatcagtgccggtaaagaattcattaaattgatctttttgcaatcgatcatagtaattactcagaagagagacaaacagactctttccaaaccgccggggccggagaaaaaaaacaaacggttcctgattctcttcaagaacccggatgaaccttgttttatcaacgtacagatatccctctctggcaatggtctggtaattacttataccataggggattctctttccggccattctatatcactatggttatcatgctatttctattatcaggactcacgtggaaatcagccggcaacaaagacccggtacacctgatcatacacctgaactgctgaccataccccggtccttacaattcccttgctgttccatacatcatacaccgttctcccggtccaggtatacctgacaaggtctttcacatcacgaaatgttggaaattctgtcagcacattatcaggcgggactgaattcaattcatcataatcagaacaccagaggacatttccatcactatccatgagaactgcaaatacatccggatttaaaccagctcttttcgctgcaacctcaccaaaattctcatcattcagatgaatcatgagatgttcaataccctgacctgtccggacaagccatataacatcccttcctgaagatgttatgtgaccggtcccaaaaggaatctcgtagactgattggttgaagataaagggtcttcgctgatcatgagggaaatcatagggaatgtgagttccaataagagacgtatacgaatcatcagagatatgagatatgattccatcagaggaaatcagggctgcaaacataattgcaggattgtcagatgttattgatgacaaaagaggtgtaatgtcatcactacggatacccgggttcgcaagcttcagcaatatggttgccgcctgctcatcaatatctatgagagaaccaagaatagcttgccgaaatgagaggcagtgagtaacataatgttctgaatctgacatatcagcaatagatacctgaaccatcaaagccgtcatgaagaagaggaggaccgggtagttcatactggttgtttcagcatcgggataaaaattgtttcctgttctgatgcttctcaccggtatttctgctaacactgatgtatcttctttaccttctcccaggtcggaataatgagaaacctctcgtccatgccccggaccatccaggtaaaattcttttaaggactgcaaatgttgtggtatccagctggcgtatagccgggctgaaggatccatcataccaacaatcgcttttggatcagcagactgtccttcaatatcaacctttatcatatcctgatagaattcatgtataatggatcagtcacaagagcctgaggactattacccggatcgggcatgttcattattatctgatccggcactttatatcaatcgtgaactctcctggatacgatttaatcagcatgtcctggacgaggcaaaggatccgacacatccccttctggaacggataaaattcctggccatcttcgccaataatcttgatgaattcttcatggtcagggtatccgggctgcatcatcaactggcagagggtgtcctaaagctacctcccgatggcctgactacgatggagcaactggagcggataaataatgaccttgttcccctcctgaaagagcagacacgggtatggtcagaggagataatccccgcactgcagaaagcgggaatcattattcattccagattaacccttgatggaacaaagcggaaacaacttcggagattcttcttccgcgagatatttccggtattgacaccactcgcctttgacaaatcgcatccattcccgtttatatccaaccttgcactcaatcttgcaattatcctcaaacgtccgggatcacaggaagaactatttgccaggataaaaatcccgaataccttattcccccgcctgattgaacttcccgccgatccagacggaaaagatatctcaggaagacaggagtttattttccttgaagatctcattgcagataatcttgacctcctctttcccgggatggagattgtggctgcgtacccgttcagggtgacccgtgatgcggatattgagattgaagaggatgaagctgatgatcttttgagtgcagtcgaacagtcgatcagcaaacggtggatcggaaccccggtcaggatagagatagcggaggatatgatgcctgctatcgtggatatgatgggggcaaaacttgcgaaatacccacatatgttctaccgggtcaggggaccggttggtcttgcagatctcttctgtatgatgaatatagaccggcctgatttgaaggatactccatatgccccgtctgtgcctgaccgactggagcgggatcctgatatctttcatgctataaaacagcgggatattattctgttccatccctatgagagttttcaaccggtgattaagtttttagaggctgctgcacatgatcctgacgttctggctattaagatgaccctgtaccggaccgggacaaactctccaatcgtgcaggccctgctggatgcccgtgaacatggaaaagcagtttctgtcctggttgaactgaaagccaggtttgatgaagagaataatatcgggtgggcacgggcacttgaacgggcaggtgctcatgtggtatttgggatcatggggctgaaggtccatgcaaaactctgcctcgtggtcagaaaagagaagagcgggattgtcaggtatgtacatatgagctcaggaaactacaatgccgtaaccgccaagatatacaccgatattgggcttttcaccacaaatgaagagattgcatcagatgtttcccatctctttaatgtcctgaccggatattcacagtttagtgcctaccatcatctcctcgtggctcccggcgggattaaaaaagggataacaaggcttattgaacaggagattgagcggcagaaggaacatggagatggcaggattatctttaagttaaacgctcttcaggatgcaggaattatccgtacactctaccgggcatcacaggagggagtgaagattcatctgcaggtcagagggatctgttgtttgcggccggggattgaaggaatatccgacaatataactgtcaccaccattgtagggagatttctggagcatacacggatatactacttccataatggaggggatcccctggtcctgatggggagctcagatctcatgccacggaacctgaagcggcggattgaagtcctctacccagtccttgatcctgggatcagggatgagatcatcaatacgatactcccggtccatctgcatgataccgtgaagacaaggattttgcaggctgatggatcctatgtcaggatcagcaaagagagcggagagcggatgcaggcacaggaatggctgatagaaaaccggggagtctggaacagaaatctcgtgaaagaaacggtcagataaatatacgacaaaggagcggggacaatgggactagataagatcgagaaaagacttccggaggacattctggcatctattgatgaagaggcgatacggtctggcatcacccgccaggaggctgtttccaagctgattcataacgttacggcacaacgaaacgggaatgagacagaacatctgaaacaggaagtcaagtctctttcaaagatacttgccatgaaagatgatgagattatgtacctgaggtctgaactgactgcggtgcataaaggcctttcaaaaatggcagattcacttgcatcaggaaataccaccattactgatattgagcatctcttccatccggtacaggagagggttgatgaactctctgggaactatgacaacttaaaacaggcatgtgaatctgccagacacgtaccatatgaacagcacattcctctcattattatcggaaccctcgccgggctgcttgtcctgtacctgattattatgaagatatgagacaggaactgacaagtaccacagatttatcagcacatactgacaagtgagaggtatagattgacgatgaccatcagggccggatttcttaccggactatgcaaatatccacgttgaatattgaatcatatgataccaaaaattctgcctcattccaagggttcactgaaaaggaacctcatgattctgttcatcggtatcattttcatctccctgatctcggtcaccggatattattatatcgagacatcaaagcagattgatgaacggttcaggcagaaccttattcagacagaactgggattgaagagtgcatctgatcgtataaccaaagggcagatgctctgggaggcaacatataaaaaacctcttcttgccgtcacaaacctggtcctcaaggagtatgagcggtcatcccgaactccttcagagatgaattttgatgatatcataacccgcatcgatccggcatataaggaccggattgatatcatgctgatcaatacctcaggggtcgcagagtattctaccaataaaaaagacttataccttgatttcagtaagtgggggccgttttttcagaccattaccgacatgcggatgaatgatacgttccggcttgaccgggcggtccgtgggtttgattcagataatccctggagaatatttggataccagccgactcccgaccaccagtacctgatccagaccacctacaggatttatgatgattatacaaaagagcggagtgaactctctttacatgctctggttacccaggtattaaaccagcatccctgggttctggctttggatcttatcgggagcaccggtatgatcacaagtcagctggatgaaaatccggttcaggctgatccgcacgatgcggagattgcacaggatgtatataccacccatgaaacccgggactttcctgatgagagaaatcagacacttaccaggttcttttttattgagagtggtgataatgtaagtcctgcttctgcgtatattgatcatgtcgcaaagatagtctattccacacagcactacgagcaggagaaaggatctctgcttacactggcaatatctctgattttaattgctatcatcctcgcctttgcccttgcatacctcctgtcgaggtatatcttttcaccggttgacacattgcttgcagaccttgacgaaatttccagaggaaacctgaatcatcagataagaccgtcgcggcaccttgagataaacaggattaatgatgcggtatccaggatggttgaatccatacggggcagtatcagatcgcttgaaatctctgaaaaaagatattccaccctgttttcaaatgcgtcagatgccatcatactctggaatggggagagagttatccatgcaaatcctgctgcattcaccttatttggatgggatgaaaatatcagagaaagggccgggtctacaccaaatgagataataagatgcatcttacagagaaaaaatcctgaagaagacgaatggaacatgaatacagatatctccggcaaaggggcctgtaccctcaatatcaggctggtcaggttagtcctcgaggatcttcccatggatctcattcaaatccgtgatattaccagggagacccggatgcatgaggagatccaccggctcgcagacattgtgaaaaacacacaggctgggatcatggccggaccagtacatgcccctgatattgtaaataaagcatatgcccgtattcatggatgtaccccggaggaagcgatagagggaggatttttcggatttattcatccagattacaaggaggatattccggtctggatacggattgcaaccgaacgagggcatatgaccggagaggcgatacgggttcgaaaggatggatccgaattccctgcattacatgatctgaccatcgtgacagatgcccatcatgagccctatcttattttaaatgtccaggacatctctgatcagatcaaggtatggaatctcactcttgagaaggaagcactctccgattcattaaatctcctgtccggtatccttgacagtctgccggatcccacctttgtgatcgatatctccggacatgtccttgcatggaacaaggctatgacggtcatctcaggaagatcagaagaagagatcagagcagggaagatgtcacatgcacaggcagtatatggtgaagaccggcccatgcttattgataagataatccgacctgaccttgatatttcacggtattacaccaatgtcaatgaagagaatggcatttactctgctgaagtcatcaatcatgaccgggaaggaaaaatacgatataaatgggcgatagccggaccgctctatgattccaaaggctcaatgattggagccattgaaaccatcagagatatcacagaattaaaagaggccatgaaaaaggaatctgagctggcaaataaactgatgctgctctcttccctgaccaggcatgatatcaggaataaggtgacggttattgacggattccggttctttgcagagagtgagacagataatccgaagataaaagagatacttgcccatcagaagaacgccattcaggatattggaaaactgatcgactttagtaaagcataccaggagatcggcattcacgagccggtctggcataatgttcgtgaattatttgaacgggccgttcggcaggtgtcaattgacctgaaggtcgtgtgtgacattccatcccttgaagtctacgcggatgccctcatctaccaggtgttttataatctggcagagaattcactccgccacggggatcatgtcacgactatcagattgtatgtagatctgtctggggaatcgcccctgttaatatatgaagatgacggacagggaattgtggatacgcaaaaagaacagatatttctacgaggctatgggaaaaataccggtcttggtctgtttcttatcagggagatcctggcaatcaccggaatcaccattgttgaacatggtatctatggtcagggagtcagatttgagatgaaaatacctcccgatcacttcagattcactgaccagatggagcaaaatttataacctgaaccatggccgatcatctgtcagaatttgcccgacaaacgagttcactgacaggaaaaagaatccactatgatgaaggataccaattctgaacccggcaatactgccccatcagaggatttgcaaaaaacactggacctggtgaacagacggcttgaagcagtatacatacggtgggaggcgctcttcaaatctctcccagacccggttatcatcggggacgatgaaggaatactcgtttgtaatccccggtttgaagaactcaccgggcttacatcagaaaagatcgtgggacttcccattccccggcttcccatatgtactgcagataaggaggattgtaaaaacctgatagaacactggaatcatccaacacctggaggggagaggttcattttccggttctttaatccggccggaaagcggatcgctcttgatatgcagatcaggtttattgaaatggagcaatccatgctcaggttctgcatcggacgcgacataacccgtgaactcgaactcctttcagagcaggaacgtgcagttgcacagatagataagaatatggctcaacttgccgcgttaaatgatgagattaaaaatccgctcacgttgatctccatgagtgccggacttgtggatggacctcaccaggagcaggtcctcagaggagtgcggatgataacgtcaattgttgaccggcttgatcagggatttaccgagtctgaaaaggtcaggaaattcttaaagcgaaccattgacgggtttatggaggatcataaccacctataacctgattgcgcccggaaggttttatcaccccttcttttccactggagaatggaaccagaacggttcgatcatctattccttacttttttaacttttcattattctgtctttttggaagcatgaccgtaaacgtggcaccttttcctgtgcccgggctatcgacagagatggtcccaccatgaagatcgactatcttcctgactatcgaaagaccaagccctttcgattccggatcatgccgggaggcgtcggatataaaaaactcatcccagattctatggatatcatcaggatgaatgccaatacccgtgtcttgaatggagatctcatgcccggttggcgtttcatgatagcgaatggtgaccgttcctttaaaggcattaaattttacagcattgtttataagattccgaaagagctggtgtgaatacaccctggacagatgaagggagacctccggcggaacatgattgtaaaataccagctccttttcatctgccatgaatgaatttgcctgaatctcttcatctatcagggacttgaggttcatctcctcaacgtcgtcgatggtatgatggctgttgagcctgataagttccatgatatcctcaaccatctgctccatgtatctaagacttttctggaacatatcaagcagactttgagaatcgggatcgcttaccgcctcttttaccagcgggagaatggcgaccatgggagtcaggggtgtcctgaggtcatgggccagctggtatatgaactgatctttctggattagaagtgattcaaccttttgtgcacgttccttcagttcctcattcagcttgcggatctctactgtatcttctgatacccggccttccagatcagaggtcagcaatgcaagttcttctttgacatgtatgagctcctggttctgtacggcaagtttttctgcctgcatcctggccttctcttcagcggcctgcaacaattcccgttccctatcttttctcatccagagaattgaaaggatgatgacaagcagacagagaagagacgtgataataaccggaataaggaccgctttaaagacgccactctcccaggatgtcgcatcaatgtctatgccaaggatcgcatggaccgttgtgtcgtccgggccatatatcggcacaagaccagtcacccatcgcccccatcggtctgagagcgggccttcaacactctcctgcggatgggtgaacatatccctgattaatccggatgcctcgtggtatctctgacccggatgcgagtacataaccgaagtatccggttcagagtctgccaggaataccagttctccatcagggctcttcccgagcaggtaaacaaaccgggtcagggggcgactttgcgccacatcagtgagatatttttttatccggccatatgcaggtgagttcaggtcagatatcgttcccttaagttgatacaggtcttccctgattattcccactgacccaatcctggtatcggtgagaagatcctgacgcatctcatcctcctttattgagatgctgatgatcgtgaagagagcaccaaaaaaaagcagacctgccagcgagataatgactacctgcaggaatcggttcattctggtatatgacagattaccctgacaagtagatatgatatatggtttgatccggatttagagggatggggcgggaaatgcctggatcagaaaccagatcccaaagaggaccaatataaccccacagagcacaagaatcccctgatacatccgattgcttagcatcatcctactgtggtgaatactgatagataccagggtgaaccatccaagatctgctgcccagtgaccggcgatgaatgctgcaagtccggcggccccctgggaaagagaactgataaggagggcgctgccaacggagaaccaccatatccagaagtacgggtttgacacactggtcaggagtccggctaggatcgggcctgatggagactccatgctgatatcagcggagattgctgctcctcgtgctccgaaaagagtcattccaccaaacaggatcagggcagaaccgccgattcccgcaatggctgggcggagagtttcaggaaatgatgagataccggcggcgatgagcacaacaatgaccatctcagcaatgacatgtccaagagttacccgcggtcctcctgtccagccaacatgaagggcagaacggatggttgcaatcaacgtcggacccggggcgagggcaccggtaagaccaataataaaacccatcagggcaagctctaaaatactcatacgaactgcctgtaccagtacaatgaccgcatagtttggaaggattattatgaaatcggtaattccaaagcctgtgcactatctgcacttcataccgaagaccaaattttctggattcatacaaaaatttggcattacactataatcctgataggtcatcaagtatatgccatccggtatgctatggtccttccagtctgtatagcaatccctataagtaagactccggggtatcagtatacgcaatgatgatgatatataccgacggggcgtcgcgggggaacccaggtcctgctgcctgttcatatcagataaaagatgagaatggcaaccggattgctgattatgtctgctttcttggtcagaccacaaacaatgtcgcagaatatacggccataataaaagcgctcacgagggcagctgaagagacaaaagaagcgatacatgtatactcagatagtcagctggtcatcaggcagataaccggggtataccggattaataaacctcatctgaaagccctgtatgatgaggttatggttcttgcatcccggttctcacattgtatctgggagtatgtaccacgaacccatcctgatatcgggtactgtgaccggctgtgtaatgaggaactggaccggcaccggtaatgacccacagacatcactcagaattatcacctcggacgaagaggtatgtaccatggtacccccggatgccaggctcctgatagtcgatgatgatcccgcgattcgggaatttttgaaaaaccggctcatgatggagggctatgaggtctcggaagcagaggatgcagagaaggcattggaaagactggaggaacacccggatacagacctcatcctcctggatgttatcatgcctggtgcttctgggtttgatcttctccgaactctgaaagaagacagacgatactgccagattccggtcatcatggtcaccgcgctcggccttgttcaggacaaggaacttgctttcagacttggtgcaggagattacctgaccaaaccttttgatacccgtgaaatgctggcacgtatcgggacccatatcacactgaaaaagaagaatgatgcgatcactcataccaaccaggtactctcaaccatccttacaaccattcccggtatcgtctacatgaaggatgcagatagaaaatttctccatgtgaatcacctgtttgaagagatgtgcgggatttgtggagaccagataatcggaaagaccggggataccctgcctgatagaaaacttgcagaggcgtttaaccggtcagaggaactcatttttacccatggcatcccgtttctggaaaatgttgaggatatctcttcgaagacgggtgaaacgaagaacatattcttccgccgtcagccggtcagaactcctgacggagaattaaacgggcttgtaggagttggtattgacctgactgaacagatccagttaaggaacatactgtcagatcgggaggcatttctctccacccttatgaactcgtttccggcacggatatgggcggttgatgtgaactatcattttacccagcagaacatgcatcatgcaaccagatgggggagccttatcggaatttcagtagatgagatagagaccgacagttcggtcagggaggaatggaagaggcggtgtgatgctgcactagccgggaagatagattgtgcagtatatccctgcggaaataaggataaatgcagggttctgatatcatggacggtccctatcatcgaagaagataaaaagaccggagtgctcggcatctcttttgaactggatgaacacaccatccagagcatagtacttacaaattcagaatgtcagggtgatgaacctgcatatatatgacgggcaccggatatggttcaggttttagtcgtcgatgataccaggttcatgcgaaccattctggtaaatattcttactgaagaagggtttgagatagtcggtgaggcagaagacggtcagcaggcagttgagttatatctgaagacaaaacctgatctggttcttatggatatcatcatgccaaagatggacgggatgatggctttaaagaccatccttggagtaaaccctgctgcaaaggtgattatggtgaccgccattcagtctgttgagatggcaaaactggcattcaaatgcggagctttgagttatattattaaaccatttcagaaacagggaatattacaggagattgataaagttcttcatcaatagccgggggatatctataagaaataccagtaccaaagaaacattataatcccctgcagttcccgtacccccagcaccccccggagatgacgagtcctgaatccagaaacctccaccccaatatcagttctatttgtcgatgatgaaccgagtatgggcgatattgcccgtatttttcttgaagaccgactgggagggtgtgtcgtaacccaggtaacagatggtgaagatgccctggaacatatacatacccacacatatgatgctattgtagcggattatgagatgccagggcttgacggattacaactcctccggaccttacggggcaatggtgacaatacaccctttcttgtctgtaccggtaaaagcaggcatgaagtagtcattgaagccctgaatgccggtgctgatttctacctgcagaaaggggaagacccccttgtcctgtttactgagatgaagcagatgatcgtccaggcagtgacgcgaagacgatccgagaaggcgttggcaaaatcccgaaaccttcttgaagagatgatcgattttctcccagatgcaacgcttgccgttgattcatcacagcgtatcatcgcatggaaccggatcatggaagaactgaccggtatcccgcctgcagcggtgctcaataaatgccaggatttttcagaatgtacctaccggtatcccggcgtctcttctcttattgagaggatcctgattcttggagaacggacaacaggagatccggataatcacggaattgaaaacaggatcataaccgaggagtaccatggccatgtcggggagggtgatgataatgaacggtattaccggatcatggtctctcctatccttgatgcagatatgcaaaaagtcgggttcatcggatcggtcagggatataacccttcagaaacgctatgaatatgcacttcttgaaagcagagagaactttcgtgcacttgttgagaacaacaccgatattgtcatgagatttaacccggaaggaaggcatctgtatgtaaatcctgcagttaagccatatattccattccctcctgaaaacctcatcggaaagaagtacggagaactggcctatcctccacgactggctgatgattgggacgccctcattcagcaggttatagaaacaggaaaaccacatgaagcagatatctcattccagtcaccgaagggattggtaacctttaactggcggctttttccggagtttgacatggaaggaaaggttcgatctgtcctctccatatcccgtgatattacctatcagcgagagtttgaacaggagaaacaggcattactttctcagatagagagaaatcttggcgaatttgctatcctcaacgacggaatcagaaaccctcttgcggtcatcaccggctggctgtccatgatggatctccatgaagaggagcggtcaacactcatgcatcagataaggcagattgacgagatgataaccaagctggaccggagatgggtcgagtcagagaaggttctcgggtttttacgacgccattacgcaatccaggcagggtatccgaaccggtcttcagagtgagcatgtgtggaagatattgtattgctgcatcccccggtgaactggcagagcgataccatgtatcagcccctgcattcttcttccccaggtttaatgttgccccttcagaaccgattcctgcagtcatttcccatcagaatcataccgagatattggttgggaattttggtttctcacaagggctgaaaggaagagtcataaatgccagagtagagagtattcaggaaaaacctctcttcaaatcccacctgcaatcaggacgatgcctcattcctgcttccggatattatgaatggaagtcggtcggaggaaagaaagagccatggtacatctatcttccggacgttcccatcatatcttttgccggccttgtacgaaccatgcatgcaggtcatgagatggtaatcctgaccacagaagcaaccgggccaatacaggagattcattcccgcatgccactggtcctctcgcagcagggagaagaggaataccttgcagggaaacatccggcagagacagagaggtatgacagttcagagtaccggatgcaccgggtatcagatctggtaaacaagccgggcagggaagggccggaccttatcagacctgtggccatgaataatgcccagagaactctggacatgacagagccggagtaattactgctgattgcctggagtatcacacctgataggaaggactatggtaaaagtagttccctgatcaggaccgtcgcttgatgcaataatggtcccatgatgtttctggacgatcttccggcagattgcaagaccaaggccagttgaactcttatcatgccgtgatcgatctgatttatagaattcttcaaatatcaaaacctcctcaccagccatgagccctattccggtatccttcaccgtaagcgttatggtatcatcatctctcttcacctggatccggatgtatccgcctgacggttttgaaaacttgatagaatttgagataagattatcaatcagttcctggataagtatctgatctccctgaatgatacagccttcaggcacctcaacatgagtttcgatatgcgcctgcctgagtgacatccggttgatctcaagaactgaccggatggtctctgcaagatcaatatcatcacattcaggaatataatccagtgagttcagccgggctaatttcagggatttggatgcgatattctgaatatgccgggcatttctctcaatgatccggaccatgttcgcatgctcctcaccatcaagttcatcaagccgtggtaaaagcccgaggatgggagtcagcggagtccggagatcatgaccgagctgcatgataaaatcattcttctgctctaaaagcctcatcacctcttcagttctggtctgcactatccgatcaagatctgcattgatttgaaagagctgatcccgcactgcctcaagctcttttgtccgctcttccatctgcagggcatataaccgtatcttctgctcattctcttttctctttgtaatatcagtaacaacaccaaatgacccggtataccggctatagggatcaaatgacggtgatgctgatatctctgcaataatctggcgattctttgcagtaaccaggggaatttcatatcgctctgacagaccactcttccgattcttcatcttttcgcgaataatttcgtgataggagggatgaatgatatcaaatgtacttctcccgataagatcttcaggagaagcctccagcatttcagccatccgggtattgacaaaggttgtcttttcatcctgatcaacaatccagataccttcattcagcttctccacaagacgctgatactcctctttactctccctgagatgatgttctttctcctgaagactggatatcagatcattgagatgagagattaataggttcagacttgtttcaagttcagaaaattcatgactccctgagtaggatacccggtgattcaaatcgccatgggctatccggttaatatcatcaattatccggcgaatcggccttgtgatatgataggcaagcagatatgcgatgaaaaatccgagcagcccggcaataagagcaacgagtgcatggaacaaccgtatcgagtcaagatgccgttgcatgacagtggtatcatattcaatccgtgcaaccatgtcaagcatcgttcccgatgccgtcttatcatcagagatatcaataaaataataatatgtttcagaggaattcaccggatcagagatttttatccggtcggtaccctgaaatgccttctgaatatactgaatagctgctggatctgatgatctcttctgatcatccatgctccacagcgtcctgaacatggagtcatataatgtcactgaacggaggtgaggtgtttcattcacaaaggcccgcataacattggcataggaaaaattcctcctgtcttcagtaaagtcgcggatataatatgaaatttcaagaagataccggtgatccggagtggggtaataagcgaattttcgtgattctttcaccgagctaaatccatataccgcccggtcggcttcgaaaaccgaaccatttcgtatccgggtgattacttcgtatacattcggccattttttaaaatcaagaccgatatctcctttataggtagcatcaatcacgatcccgttctcattaataatataaacatccgcaatatcgataacgtccgggctgaacctgctttttatttccgtcacattcatcctggcaggatcgcctccggactgattatacgcgtccagaactatggagaactggtctttcatggatttatcaaaggtatgatcaaagagcaggaggccctgattaatcagttgcagtgagctcttcagatggtgctcattatgttgtacttcactctcccagatatcatacagatgctgatttgtctgctcataggtaataacagacatcagaacgataagaaaaatgaaaccagtggtcaggattatcattaccagtacaggaaaagaaaatctgatacgggatatttttcctggtttttcagaactgtccgacactgttcttcctgggggatttatttgagtttcttctgtaaagaacgtatttatccgttccaactacgatctctgagaggaactggcatcgggccctgatactatgataatgataccggaaaagatatgccttgtgtcctgcaggtatgcacggatatgttataccgctttagggacggtttttgttatcacggcagttatagggattttcctcccgctccttccaacaaccccctttctcctgctggccgttctctgttatgccaggggatcagagaggttttatacctggatcatgcatcaccgggtttttggtcaatatattagtcaatataccagcgggaaagggatgtccctgaagtcacgtctgggaacaatcctcctgctctgggtggtaattggatgcaccattcttttctggatcagatctgatatcatccgcatcattcttctgatcattgcactatcagtgagtgtcggactctatatgatgaaaccacagccatggaaccaagaaaaagaatgaaatctatactttcttcttcgcaaaaaacggcttggccgctttacatcgcggacatacccaggtatcaggtatcttttcaaacaaggttcctgcgacaatgccatgctccggatctccaaaccgctcatcatacacgtatccgcattttgtacacacccatgctgccatatctgaatatctatcgcccggggtaatgaaggatccgaatcgaatagaccagatttgcaatacagattatctgatatacatgttcacctgtttttcactttcaccccatatcaaaatattatatgccacttgagaaaaatgctcatgaatcagtttagagaaaaaggattgaccctcaagtaagagagatcctgacctgaaggagagagatatcaaagcaggtttttgtatgtcagagctgcgcaatgccgcttgtcaaagatgaggactatggaacagagaaggatggcagcagatcgtctatctcctgtactcactgctaccagaacggtgaattcaccaaccctgatgcaaccgtggaagggattgcggaacttgggtgccatgatctcacagatgtatggaatgcccatggataaggccaggatgttcatgaccggtcagatccagaccctgaagcgatggagtgggagaattgtcccttactgtcagagttgtggtatgcccctctttaccagtgctgatgccgggacagagaaggacgggcaggagagttctacctattgtatcacctgttaccggaatggagtatttaccgaacctgaacacactcatgaaggaatgattcagaactgcactccgatgcctgcacagatgttaaatctgaagccggaaaaagcagaagagatggtaagggtatttaccaaagatctctccaggtggaagtaaattacccaagtgtcacaactagcattgcttctgcatcctgcagtgatccggtgggattcccgtaataatatgagacagtatctccggccatgagtaagtagagattcagaccatcggtttttggttctgcataatcttccagaagttctccatttactctgacaaaccacacttttgttgctgtgttgaaaaattcattaattccttccagaattaagatgcctcccttatgcataccacggtcatctatacacagattctgtatctttttatctataagaagcatgtgaaggaccccgagcggggtgttcaccggtatctcgtactcaatcccagaactatccgtgacattaactgttccctccgggagggcaagtacacctgaatagagcatccggttatcctctttctctgcagcgggtgttggtttagggagttcttcaaccagatccgtgatattggaaatatttccggtttcattcaccggttccttcgtgggtgtcaaaaccaggggaacttctgccaggggagtgggaacaggactcggaacagcggtagcatctacaaccggaacagcagtaggaacaggactcggaacagcaggagcatctacaaccggaacagcagtgggaacaggactcggaacagcggtagcatctacaaccggaaccacagggggaacaggactcggaacagcggtagcatctacaaccggaacagcagtgggaacaggactcggaacggtaggagcatctacaaccggaaccacggtgggaacaggactcggaacagcggtagcatctacaaccggaacagcagtgggaacaggactcggaacggcaggagcatctacaaccggaaccacggtgggaacaggactcggaacagcggtggcctctacaaccggaaccacggtgggaacaggactcggaacagcggtgacctctacaaccggaaccacggtgggaacaggactcggaacagcggtggcctctacaaccggaaccacggtgggaacaggactcggaacagcggtgacctctacaaccggaacagcagtgggaacaggactcggaacagcggtgacctctacaaccggaacagcagtgggaacaggactcggaacagcggtgacctctacaaccggaacagcagtgggaacaggactcggaacagcggtgacctctacaaccggaacagcagtgggaacaggactcggaacagcggtggcctctacaaccggaaccacggtgggaacgggggttgatacgacaggcatctgtgaaataacatactgacccatcatggcagaaggagagacaaattgcatcaccccattcttgctccccacctgaacccagataagggcttttgcagcactggcaggcagggtcggatcaccgtacgcgaaaagaacgtcatctccatccttcaggagataggtattcagaccttctacagaaggaagaaggtattctctcagctgaacaccattcaccaggacaaaccaggcatcatgttcagtcacctgatatgaatttaccccgtcaagggtgaaaataccccgtttatcaatcagctcatccccaatccgataactggaaatcataccagtcccggccagtgcctggataatccccaccggtgtcatagcaggaatctgatacaaagcccctgaatcagcccgaattgacacatttccatccccatatggaatctgaccggaaaagatcacaacctggttctgcacctgctgaacaggatttcctgcactacaacaggatggaaggatcatacagaacataagaatgatcaggatacccggtacccatgccctcatactacccctttccctcatctggttcccatctcctcgtatatcacatgcaatggctgtaagaatggtagtcggctgaatatataagcgatttggctgatgctctgattttcaaacaaaaagacggtgttctgtgagaaaaaaccgatccatacaggcaacttttatataaagcggcagatattgatagtgtagatacatggaattcgaggcatcaggattactattcaggaaagtcgccctccctgaccacctgcctggatccttgttcctgcatcctatgcctggcaggtacgaagacatagggacctttctagcagaactggaaaaacgaaatattcagacgataatctctcttccctgctttgatgagattgccagcatatctccagagtacatgaaactaatcagggatgaagatcgggcaattaccatcgactgcttcccgatttcagatttcggagttccggagcgccctgatgaccttctgaaactggcaaaaaaatatgcagaatacctcaaaaaaggagattctatccttgttcactgccggatggggataggaagaaccgggctttttgctgtcgctctgctcatggcatcaggaattgaaagacctcttgcggaaaagatagtgcggagtgcaggagccgggccgcaaacccggacccaggctgactttttactatgggcagaacaggcactgagagaataaacccccggattgccaaatacagaaaaagtaggatttcaggccttcttctgctgtaggtaccgcatcttccttgagagcatcagtccgacagaagggtcaccacctaaagagaacgcccgctcatgggcaacggcagcctcttcaaaccggcctgcattttgtaacgaatccccttttaaaaaccaggctttggcattggtatcatcaagagccagaatccggtcaaatgctgccgcagcggcattatgatctgcagtcatccagagcagctctgcatacaacgaccatgcctcagtactctccggagttttatcaatgagccggcgaacaagtgacagtccttctgcatatgaatcagcctcatagagggattttacccttgccagcatcagaccgggatcatcagggatctgccggagtgcctcttccaccgcctgagctgcttcatcctctctcccaagcgtctgttcaatctctgccttcaatttccaggcttcggcattctccgggttctgttcgataacctgatccagcggaggtattgccgtcagcaactcaccggatttaatcagactttgtgcatacctgaagagaagatccatatcatccggacgataaaggatcgcctgggagagggcagcacttgcagattcatacttcccctgatgaaacagagccttccctttcatctcccagatctcaggatcatccggaaccacttcaagatactggtcaaaccgtggaagagacttgtcacatttcccggtcttatacagggctacccccagttttcgtatgagatctggatcatcctgtaggaactctgctgctttcaggtaggattcacaagcctgatcatattgctgcagactatcatgggccgcccctttccgtttccataactcaccattcagcggatcaaacccgaggaccttgtcgataaccgatatggcctccggatatttctctgcttcatagaggacaatcgcctgcaaagataagagttttttattattcggggcatatttacacgcctcagtaagagcattcgcagcctcatcaaacaacccttgggcacgttcaatctctgcccgcatcctccagagatcaggattcttctcatccttgaccagcaggcgggtgacacgactatatgcttccctgaactgaccggtgtgatacaaagcacgcatgtatccggtaagaacctcagtatcactcgcatcaggctcactgatggcagcatatgtctgacaggcaccccggaatgaacccagagcaacctggatctttgccttcagttttaatatctcattgtttgacggagagagatcaagggcctttccaacagactgcagggcatctgcatacgccttcctggtatgctggacatccgcaagcagataccaggcatcagcagactgatcatttaactggagcgaatgtttcagaataaattctgctttctgaagttcatgtaatgcgacaagtgccttcccatgataataccaggcctgatcatcatccggatgattatcttccactccctcaaatgcggttattgcctcggtaaactgatagagctcaaggagggtcagaccggcccagaaaagggcatcagtatggtccttgtccagctttaatgtctctctgaaatgatgcagggctgcctcatattgtttcaactcatactgggcaacaccaagaaggaagagaacctctgcatcaggtccgaacaattcaataaaccgctctgatgccttgataagtttctggttttcatgttcataggccagagcattcaggtatatcagccagctgtcagaggggatcggaccgaatttacatgcacgctcaaacgaatgaaccgactgatgatattctcccagctcaaagctggtaatcgcatggttaatccatgactccggctttgcattctttgtctctgcagcatgttcgaatgattcaagagccgccgggtgactgtcaagcagccggagagcaagtccacgctgattccaggcggttgggttttcaggatcaagttccagggctttttcatatgcagcaattgcttcctggtactgtccgcgttcaatctgggtatccccaagcatgatccagatgtttactttccggggactgagctgggctgcatgggtgtatgcagctgctgcccggctgaattcatactgggcaacggcgaccattccgataccaacccaggagttgacatttttcggattgagttttaaggactgctggaaggatttcatggcatccttgtaccatttaagtttatagagggcagcaccatgattatgccagacggagggattgtcttttcccagttgcaatgcccggttaaatgcctggagagcactatcatacttcttcagatgcatcaaagtaaggccatgattattgtaaaaggtgaccgactcctggccttcattgatgatctggtttaatatatcggtgacggcagccttatcatcagataactcggctttcaggattgagtacgagtaccgggtatcaagatcccagggttcaagcttcagcacgtgctcatatgcactggtagcctgagggatatcacctgaatctgcaagcaggtctgctatcattcgccaggcatcagcatagtccggatcgatctttagggcttttttcagggcatcgatcgcctgttcccgctcttcaagatggacaagagtgtttgcaaggccgaaaaatgcaaccggatcatctggatttatctcaatggcaaagtaataggcatcaagtgcgtcggtatattctccaagctggacatgacaatagccttttaaaacccagacttccgcctgttccgccccccagtcaatcgccatgtcaaggtcggtgagagcttcacgaaacttgccaagtgcaagatagcaggcaccccggtacatccatccctgatcattctcagattcacgctcgacaagccgggttaaaacagggatggcctctttatacatgccgacttcatgcatcgacataccaaggcgaagctgggcctgcagattatccggatcgtacttcagagcgttccggtacatcttcatggcatcccggtgacgctcctgctttgccagaactattccggtctgataccagagttctgagttttcaggatcgatgcgaagaccttctttgaatgcatagtacgcacggtcctgctgatcctttttgaggaacgccatccccattgacagccatttctgaactttatcggccgttccaatctcttttgccagaattctcctccaggctgacctctaccggagatactcactctctaaaaaatctgcatatgataggtggatgacatgatacattaaagtacacaaaccctggagtcctggtcctgacagggaggcctcagtcttccccctcattgcccgaatttacctttctttgggtataaaaacgattgtatccggtctcctgcatcatcgccagggatgaacacaaggaggggaagatccatcctgctctgcctgccgataccgtgacagagtaccccttccagaacagtaccctcaaatcagacttacagcagacttgaagggttggatctgcctgaacctcacactctttcaatggtgcaggttatccattcctggttaaaggtcggggaatatttattgtaaaagtttattgccggttcattccattcaagcacctgccagaccaccccgttcagattcttctttctggcatcatcaagaacggcgtcaaatagcatcttaccaattccgcatcccctgaactcttctgttacgatgatatcttcaagatacagccgttgtcctttccatgtggaataccggatataatagagagcaaatccgacaatatcatcatcgacttcagcaacgatcccccaccagaccggacagggaccaaacccggattcttcgaaatgctctaatgatacttcaacttcatgcaatgcacgttcatattctgcaagctccctgataagttcaaggagttgtgggcagtcattacgaactgcaggtcggatggttacgctcatttatccatattgtatttgtcgcaccctgattatatttgataaagctccaatagcaaaggggttaggtaataaagcacatgacatcaccagaatctttttcagatcttaccgatttgctcatccgggtcatccatcaggctgttgatattgaaaaacacccggtggatgtggggtatggtgatgttctttctgcatctgaaatccatctcatagatatcgccggcagatatccgaaggaaaaactctctgaaatcgcaacacgactgggcatcacaaaaggggcagtcacccagatggtccagaagcttgaggagaagggatacgtaaagagagtcagaagcactgaaagcaagaagaccgtatatctagatctcacttccaagggaatgcaggcgttccgatggcacaccgatctccattcccggcttcaggcagactttttgaaggagatatcagatatgccggaagaacagatagagggggcgatatccatcctccggtgctatgaaaaaattctccagagaagtatggagatcagggataaatctccggattcagaataggtctctaatccttactctgaatattgtgaagggagccgaatgaattatgataatttagtaactaaactattgtgagacaatgacacagacacctcatctcatctttgcctcgatcaccgaatctgacaaagaaccagtcatcgccctgttcaattactatattgaacataccaatgctgcctttcttgagtctccgctgccatcatcatatttcgatgtattactgccagtcattgagcagtacccgtccgtatcggtaaaagagaacggagcactcatcgggtttggcttgttacgcccccataatcccatgccagcatttcgaaatactgcggtcatctcgtacttcctggaccctgcatataccgggaaggggattggatcaaaaatgctgaatttcttgatcgagaaagcacgggaaaaaggcatccgatccattcttgctgaaatatcatccctcaatccgggaagtgtcaggtttcatgagaaaaacgggtttattcaccggggacggtttgaacgggtgggtgtgaagaatggaaaagaatttgatacgatctggatgcaaaaatctttgtagaactcgttatcaagcgtgaatacagtatcacgaagatatatagcggttctagcggaaccatccacatccttttcaaagagttttttaatcaaaaacaaaaaaattttacagttcttcgatgatcttcatccaatccttgccggttttgtgggcaacatctttgataatattggacagggttcctacttttaatggatcgtgcaatggaacagtaattccgaacagttcaccgtgtaccactcattcaagacgaacatgacttcctgtttgtctgacttttggaaaccctattgaaattaggtacgagataagatcatttccagatatattttaaggtactttcatacggcaataacaacatcctttacaatatggagtctaatcagactgggaatatcatcatcgccaaaatgacacattaccgcatcacggaccatatctcgaagttcatcaagagtatcggcctctgtataaattgaatgagtcaccgaacgagctacatagcctccttcatcagattcttctacaagaaaaatgatctcggtatctctatgttttgtcagtaataatcatgtcaaattcattagggtacgcaaatataaaagatttatacatatagagatgaaaactggttaaaattagtagtacttaaagaaaggggccatattttttcaccttcaataataattaatcagtcgaattgtaacaaatgtattgacacatgctcatccatcaaatcatcttaacaagggtaatggaaccttgaaccgtcacaaacatacccatacacaagtctcccggttcattttcctctttttgtgccaaacgattcattgacccgtatgaacatggtatcagcaattcccactagtaacctaaagtccgccattgacttcagtccctcaataggattacacactgtcattatctcatttttccaaaaatttattgggattatttctttttcctgggaaagttgagttatagtatcttttcagaacagatttgagatatggtctctttcacaactctttgatagtcgccacggttaccatcaaacttcccgaattcttcctttctgaaaataaaccgaaattggacttatgttactcctgaattatagatttttattgggatatggttcgcataatacgagaaatctttgtctaatgtatatattttaaggtctgcttcagttgcaacagcacaaattaaaaaatcagtaagtgagccctgaactcctgccttcctacagatattgaaatattttgctgctttttcataaatctctatttttaatggcatatctggataatgcgacagatgattttttaatttttcaaactgtgctgctgatgaaattccggataataattcctgcctaattggtccaatcatcacaactcttccatcatgtattaactcagtaagattgtgaatgatctgtagttctttttgggtgtgagaacctgcccttctcaaagcgagagaccagacagaagtatcaacaagaattttcatttatgtttcgatattttttataatcgtagtcttcatcataatcgacggtcccaaattgggagattatttcgatctgtttccttctttgaatatattcaataagtgcttcggtaataaccccttttttagtttttactcccccaattcgctgtgcttccttgattaaatcatcatctaatgccaggtttgatgccataattacacaatctcctacacattacgttacacatacgtgtgaagggcggagagaaaaaccattcgttgtgcattccaggtaccagaagtaaggagtgcgccattcaccacctttttccggaatccaacccgttcaggcaagtgcggggatggtatctgtccagatctcgatggtggcaagcctcatcagactcatacctggtgaccaatacattgccccgcattggtgacattatacagttcactattcgctgcatgacacctgatcggattgtggtaaaaaatcgcagatcaattcttggaagactgtgtgagggaacctaatccggttatctggtaattgcagggatacatctgctaattatttatacaataacgatatataaaagatagattataggcaatagccagatttttcggtatgcagagggatgagggatggaacgagtgagtgtatcgtggattttgagagcttgtctgctattcatgctcattaccgcagtatggggcggagtacaagccgaacaaggatctgattatgtacctggtgaggtcatcgtcagatatgcaaaccttggatcaggaacagcggttgcatctgttgcgtcttcactgaacgcccagattggggctgagacaatctacaccgatgaggtgatgggaataaatgggatgcaggtggtaaaggtcccggatacaatatcagtaccggatgctgttcagttttacaagtcaaatgaacatgttctctatgctgaaccgaactatgtaatcactctgccaacaccattggggaagggagagaatatcatacagggactggacagtgaaacaccagggatgacaattccgaatgacccggattttgatctccagtggggcctgtataatacccttaacagtagtgccggcagggcagatatcagtgctcctgaggcgtggaatatatccaccggctcatctgatgtcattgtggcagtcgttgattcgggtgttgactataaccatgaagatctcgcggctaactgcctgaaaggatttgactttgtaaactatgatgaagaccccatggacgataatggacacgggactcattgtgcagggatcattagtgcagtcacggataattcaatcggaatcgccggagtcagctggaattcaaagattttaccagtaaaggtctttgatgccaccggtgtcagcaacacggcccttgagatcatgggaattgtgtatgccaaggaacagggtgcaaacatcatctcctgttcatggggatctcatatctacagtgaggccctaaaggacgcgattgacagtacagatgcactctttgtctgttctgcagggaatgacggatatgataacgatgaaataccctattatccggcaggatataactcagctcatatcatatctgtgggtgcaagtgatgagtatgatatgctcacctggttctccaactatggtgctgtttctgttgaccttcttgcacccgggcagaatatctacagtacccttccgggagattatgggttcatggatggaacctcaatgtctgttcctttcgtatccggtacagcagcacttatcaagagtgaaaaacccggctatgatgcaggccagattaagaacctgattctcaactccgttgaccagaaattctggctgaattcaacctgtgcgaccgggggcagactcaatgcatataaaccgctcagtcttgtcctccccttaaatgctgattttaaggcagaaccggtatcaggcactatacccctgaacgtccagtttgttgatatgtcatcaggtgagccagaaacctggcactggacatttggtgacgggtttgaatcaacgttgcagaatcccacccatctgtacatgaaaccagggaaatattcgataaccctcactatctccaaggaaggtctcagctcaattgcagagaaagagaatttcatccatgtaaaaccaccctatcagccggtgaaggcattccctgacggaaaaggaggcttttacccagttccgacagatgcggacgatgacggactttttgaagacataaacggaaacggatggcttgaatacgaagatccaaaactcctctttgaccagatcctctttgccatgaaagaagaacccatcggtcagtttgattttgataagagcggttttatcgggtttggtgatgttgtgaaattataccagatggtgtaggtgatgcagatgaaacagacatatactatcggagtgcttggtgcactgatcctcattgccggccttattgcaccggtgtcagcatactcactcctcttctttaacccgtcagttgtcgaatccaacccgggggaagagccggcgatagatctcatcatggaaggatgtaatgcaggaatttcaggatatgccctctaccttaccctcgataaccccacggtcgcttcatttggtgagatcagcttcccctcatgggtctccatgaataaggttgaacatatcaacagtacgaccatccttattcagggggctgaccttggaaaccaggttgaaccggcattgtccatagcaaatcttgcgaccgtgaacattcatgctctgaccgcagggtatgcaacattgagtgtcgagccggttgtcattgatgatgacagaaatggccggtatgaaccggtgagtaagaccgcaagtatcgttatatcaggagccggtccgaatccgatgattcccgcatcacaataggagagatacatgaagcagatatttgcatatgaagaacaggcagggcggattgaactatttataagaatagtgtactcgtttgtcgtcgggattgttctgatgatttacggatttatcgcaggtatctgcatgctcatccagtttctggtaattcttatccttggccggagatcacgaagcctttcagattttatccaggggtatctggagtattatgtccatatcctcccgtatacctcttgtatgacggatgaacggccggggatcctcccctcaccagtgagtatctacgaggaagagaaagtttaattgctgtctctgtgagactctctcacatggcaggcattattatcgatgccaaggttgaccggatccaggtaccggaaaaccttcgatattttcgattaattgaagagcaacaggagcggtgtgcggagaaagggtgccaggaagagttttttaagttcgggcttggacaatctcccttcccggttccggcacctctccaaaaagcgctctcccttcacagcggtatgggatcatacgctgacccgattgggaacatagaggttcgtgaagcggttgcatccttttacaaaacacgatttgacctggatgttgagccataccgggtgataaccgggcatggtgcgaaaggacttatcttttctatctttacgctgataaccggttcagtcatcattccttctcccggatggctcggatacctgcctcagctccggatcctgaatgttccctattaccggctctatacccatggtgccaataactttaagatccgcccgcagactctggaggcgatgctcaagggactggtaaaaacccagcacctgctcatcctgaataatccgggtaacccgaccggggcactgtataccaaagaggaactgaacgatattgcgaatgtatgcagaaaatacaacaccttcatcctctctgatgaggtatacagtctcctgacctatgatcccggctcatttgtgagcatgggaaagatatacccggagggcacttttgtcattcacagcctgtctgcgggtatgggggcagggggattccggcttggaagctgcattatgcctgaaggaatcagcccatctgccattcgtgatgtcgcaaagattgctgcaaccatctataccagttctgccgcaccactccagcaggcaggtattgctgcataccggtccggagaagagatggaccagtacctggaagcggtcagaaatattcttcggatcatgaccagcaggcttgcacacatgtgcggagccattgagggcatcagagtcacggtccccaaggctggattttacttcatggtggatatgaatccgctcacagatgcacttcagaaagcagggattatgtactccaatgatctggcccctgctctcatatcacatccctatcatatcgcgaccgtcaccggtgaagcaatgatggccccgtatggtgattttttcatacggtttgcctgtactgattttgacggagaatcagctcttcttgaatacctggaaaaacccccggcacctgaagaagaagaggctttctttgaaaagtatgggagaaggatgattgaagggatgagaatgtttcaaaaatgggtcggtgatatcagggatgggacattccggatgccggccctgtaatacctcgtatcattttttaccggttcgtcacagtctgatctcgtagtcaggctctgcatatataactgaagtctgatttttatatgcctgtactccttcagacggggtcatgttcccggaaagttcaaccagatgcagcccggacaagccttcgggggtgaaatccctgagcaacgttgcattcagtgatgcatgagtctggtttgcatacacagaaaggtttgcaccatctggaaatgctttgacattgaactggacaagcaggcgggctggtcgcttcggtgtgccgttttgtgtgagggaaccagtatcaggagttacattcttcccttctatggccccggtgttgctctcaatggtatatacaacattccgctcagcatatttcacatacggaaggctctggtaatatgcaatgctctcttccagagtcatccctggcggtagctgaaccagctggagtccgggaagtccgagctcattatagtccgtcttcactgttgccccgatatatgcatgagaagcattggcagccgcctgcagggctgttgtattccagagttcagggttaaaccggactaagagttcaccctgcattgattcattctgtacatccccgacaggtgttgtcaccgtttccccttccttttttacaacactgagggtatctccaataacaaataccccgcagatgagaagtaaccccattaccagcataagacccatagacctttgcataaagaggatattaggagcctggagataataggcttgctgtatcaaaagaatttcttctgaaaaagtcaacagatcagtatgactggtacgaatgccggccctgtataccggttttcttcctgcatgcatatccttccgccctcatttctggatgaactcttcagggtatcagccgtgcccgggatcatctcttttgcaggcggacttcctgatgcatcactctttgatctacagggaatcaggcaggcaacagaagcagtctttgatgagcatgggagagcagcccttcagtataccaccaccgacgggtatcgtcccttacgggagataattgcccgccggtattatacgcggctgggacttttggtcagcgctgacgagatacaaatagtaaatgggtcacagcaggctcttgaccttatggcaaaaatactgaccagccctggagactcgatcctaatcgaacgccccggatatctgggtgccatcgaagccttttcattttatagccctgttttttctccggttccgcccgatgatgagggacctgaccctgactatcttgccaatatcatcaggacagaagacccggttttcttttacgggattccgaattcacaaaacccgtcaggatgtacctggtcagatatgcgacgaagggaggtggctgacatcctctccggaactgactgtctgctctatgaagatgatgcctttggagaactcttctttgacggaaagccacgccagccggtgatgaaacacctgccagaccaggtcatgatgagcggatcattctcaaaagtagtcgccccgggacttcgcatcggatggattcgggcacccagacctgttctggccgcatttaaccgggcaaagcaggcagcagatctccactcaaatctcttctcccagatggtcctgaccgagtatatgaccagaaataatcctgatgagaagatacgtgcgatgggacgggagtatggagagcgatgccggctcatgaccgaccttattgaggatatgctgcccgataccgtcggtcacacgaatcctgtcggtgggatgttcctgatgctgaccctcccggattccatgcattcgatggagatatttgagaagggtattcaggaaggggttgcagtaatgcccggtgttcccttttatgttgatgacggcggatgcagaaccatcagactgaacttctctgcctcctcgaaagagcagatagaggcaggtatgagccgccttgcccgggtgtttcgggatatggcatgaccagtcttctgatgacttgaaatagaggaatcagcaacatgtacatcatggacagccggactgagaaccgggcagaagatccggccaagaaggcatatattgagggcctgaaacgatatcgtgacggcgatatgaaggaggcctgcaattatttcacaagcgctatagcagggggtattactgattttgatattctctactaccggggaatgtgccaccttgatgccggacggtatgcggaggcattgactgattttgaagtgcttatcagacagtatccggacaacatcgagtacctcttccgccgtggatttatcagatataagacgggggatataccgggagcaattagtgatttgacgatggtgcctccggatcacccggacttttccattcggtggcattacctttcggtactctattataaaaccggaaattatgatgcagcactggaagcgatagaaaaagcgctctcactcttcccgaccatgccaaaagtctggtttaatgcaggcatcatcatgcaggccggagggctgtcagaccgtgcagaccttgcaatatcaacggcggcacgacttgagccaaaacttgccaatgcaaaaagagaaattctcgaataaatctgaaagacaggaaatacgggtaatcaggagtactcaactctcctgatcatattttttacaatgacgacaaggatagccgagccggcgagcgaagcagccataaccgcccagtgatagagcggagccactccaaccgccaggagcacgataaggtttatgggattagaggggaaggccaggatgagcaggagcacgatgataactgctgtcgagaagatgaactgggcctttgtccgatcccggtaatacacggcgatggttgcagcgataaggatgagagccgttgatgcaaagacaacatgaagcaggatctcaataagcgacgcaatctgaatgccgtttatcgtcagcagaaccagccataatgccacctgcaccggaattatcaggatacatgcgagaattttcccgcagacgatatcttccagagtagccggggttgttcgcagggtgtcaagggtctgttcctggtactcctccgttatcagatcaatgacaagcccggcagatatgatagccggcataaagaggagcattgggataagaagcccgtagatgaactcgtaaaaagtgttctgggcgaccggacgggaagggtttaccgataccggtctgaagtcaagccggtctttcctgatatcacgaagtatctcctcatattcgagcaggatatcctttatcttcacctcaataaccgtggactggatatcattactgatggtatacagcgtgaccaccaccggatcttctccatcaggagggtcttcagaaggccagacaactgccgccaactggcgttctttcagggcaccaagagcaacgcccggatccatccggtagggcatgaaagagggatcacggctgaagagatcaaagaggatggtgtcattcccgacaaatccaaccccgtactgaatcccggtgatccgaccatataccgaaggatcatacatcgcagacaggccgaccatcaggaatgatgagaacagagcgatgaagagctgaagcagtatcgcaaggattatcgtcttctctgaggtcagaccgcggatctcctttcgtgcaatggcagtcaccagtcgctgattcaccatacccacccccggagcatatacagattatagatagtatgcatcacggttgcaacagtaatcccgataggaaacgcattcttcccccatatcttcactactgcaccggtgcagaatacggtccctgaatggagaagaaacggcacccagaggaggcccagagacataaagagagccgccccgaagatggaatcagcgatctgcgagatggtcacaaagaggagcagcttctcaccaaggagaaagccaaacccgataagaagtgacgcaaggacgacaatcttccaggtcagggggggataccggtgcgaaattagtccgacaaagcctgctgcctttaccagttcctcggtcatcgctgccagtaccatgataagaatgagggaatagggcatcgggaggttgaaaaagagcaccagatacatcatctgggccataaagacgaaggggatagtcatcaccgagatgaggatgagggagagataccagtacctgtttgagataagagcaccaaggtagagcgccagtgcatcaaggagtcctttctcagtaaagagctgctcttcatgaaagtttctgatacagacaccgaagaggatgagactggtcaggtaaaagagggtggttgagtagatataatccgtcagggtgtatccggtcccgtcaatcacatgaaccaccagcgttaccggggagaggagactgacaatatggacatttgcaaagatgctggggaagaagaggtatgatgtcgcgatggttgagaagaagatagagataaacgagagttccttataacttctggccaccatcccgatgaagagtgcaaatgacaggaaaaacaggataacgggtataagaggcaggattgcgagaacatccgccttcaccgtgaagagaattgcaacaacaatcaggatcatcccgactgcataggggagcatcttcccaagtaccaggatgactggcctgaccggtgatgcaataagcgcttcaccctgacgaagggtccgctcattcatgatactcatcatgaagaactgggatgtgaagtagagcgggaatataaagacaaagatgaagatgatggtatcaaagggcagtgggggagagagcatggaaggaatccgcagttctccaagagcctcctgctgggacaaaagattagtatatcttcccagctgatcagccccccgggccgcctcttcctcaagctggagacgaagatgttccatatctgcagggatgatccctgaaggagggatgatatctgtctcaatattttctggttcaggcggagtcggggatgcggttcgaggtgctgccacctgctgaccgctctgggttgcaagaaagtcgagctcgctgacaatgtactcactatcaatccagaccggataggccgcaaacaggtcggtctgctgacgatagatgtagtcctgatacgcctggtaatcccgctcaaaactcttctgggctgccgcacctttctccccgtttgcccgaaggagagacccggcacggatagcaagatcaagccccagtgacctgatattggtaccgtctgacggaagggagtagacaacataccggggatcgctgccaatgatgtccaggtacatctgactgtccaccccgacccggtagattccatcctgcagatgaatacctttttgtgctgtaaacccactgacacccaccaggagaacgagcagcactatggcaaccggtaaaaggtcccgggtcatggtcccctgaaagcgtctaatttcccatatcgcaatggtaagaagctgtgaaagagcctccattgggtgatagttcgccgggatggtatatcaaagcttaccgtaacactttaacgtagtgaagacaagaggaggatacatcactatgattgaagcatcgtccttaacgaagatgtacggggatgttaccgccctctccgatgtttcattcacctgcagagagggggagatattcggcattatcggccacaacggagcaggaaaaacaacgctcctgaagatcctatcaggtcttatccttcccacatcaggctccctggttattggaaatctggatctggtatcagatcccatgcaggtacgttcacagataggatacctgcctgaggagtcgcggctgtatgaaacgatgctcgtcccggattatctccggttctttggagaaatttacgggcttgaccggttaaccattcaggcacgggctgatcttttgctcgcccagttatccctccagccggatgggaaacagataggaaacctctcgaaggggatgaagcgaaaggttgccatcgcccgatcccttattcatgacccttcgatccttatctatgatgaaccaggatctggcctggacccgatgacaacccggtttatcattgaatatttaaaacaactcagaactgagggcaagaccatcatcctctctgcccataacctggcccaggttgaagagatatgcgaccatgtcatgattttaaagcgggggaaagtggtggtgtttggcacgatgcctgaactgcgcgaacagttcggatccatcaggtacgagatctggtacatctggccggaagattcaaagccacccattcaggcagaccagtcaggaaatctctggatgtcggtcgctcactctatagaggcactcaatgagataacgagcactatcagctccggcggtggcacggttgagcgaatcgaatccaggtacccgtctctggaagagattttggttaaaattggaaagtgatttagtaaaagatcctggccatctcatagagttcaggatcaaccttcttctgggtaatggcatcgcttagaggaatcggaactatcttgtccccatggagagcgaccattacgccataattcccctcatgaatctgctgaactgctttaaccccgtacctggttgccagaacacggtcatgggcggtcggcgacccaccccgctgcacatgaccaagaacggtgacacgggtttctgaaccgacccgctcttcaatggccctgccaagcagatgaccaataccacccagctgttcatgcccgaactcgtccacttttgaagaggccgttacaaagttattcatatcggtgggtttagccccctcggcgatgaccacaatggagaacttcttaccccgttcccgccgtttcttcaggccctcacagacatcgtcaatatcaaagggcacttcaggaatcaggatctgatctgctccacctgctatcccggcaatcgttgcaatccagcctgcatgacgtcccatcacttcaagtaccatgatgcggtgatgggattcggcagtggtatggagccggtctatggcatcggttacaatggataccgcagtatcaaatccgaaggtatagtcggttccggagaggtcattatctatcgtctttgggatgcccaccacagggatattcatctggtgcagccgggttgcaacactgagcgtgtcatccccgccgacggcgacgacggcatcaatcccgaaccgcttcagatttgagagcatttgctgggtctgctcctcactcttcaggggattggtccgtgatgtcccaaggatagtcccccccttcggcagaataccggttacggaaaattctgtcaggggctctacttccccttctacaatacccttccatccattccgaatcccgataaccgaatagtcatagagatgtgcagtctttaccactgcacgaatgactgcgttcagaccgggacagtcgccaccgccggtcagaatcccgattgtttttatcttccgagtagtatcagccatgataaatcttgatcgcatcttccacactggccccatccacggttatggcgtagatggcattgcacatccgaaccgcttcatcaagtggtttctgatggatatttctgccggttgcattcccgctgcatcctccgacatggatctgttcccagagttgggtcaggaacgtggcagcatcaacactggatccgcctgcacaaacaacctttgtccgtcctgcagcaagggttgcttcccggataagttctgcagatgatgcaccttctcctttcggcgggttaactttcacaaagtctgatccaagacatgcggcaacccctgctgctccggcgataaggtggggatctttctcattccctaccgctttaccccgtggatagatccagaggaccgtgacaagaccattctggtgtgcttcaaagatggcctgtgcagcagcactgagcatcgccgactcatattcagaacccaggtaaatggtgtacccgatacccaggatgttcagtttactgcattttctgaatgcaacaacctggtcaatggtgttgataagattagagaagggttcatgttgtgctgtcggtaccaagtgggtcttggaattgatcttaatcaggtacgggatcttgggatagtctgcaccatattttgcgataagtcccagctgagttgcaaagcacccgatttttgccttcgctgctattctgaagaggtgttcaggatcatggtcatcagggtgaatcccctcgccatagaagtcatcattcagatgctcaatcttctggtcaccggcaaaaagcatcagccgaccggaatcgtgagttatcgtcttcagattacgaatatacgtgtcctgctcactttttggtacgtccagaggaacagcaaagcctttgctcatgccttttctctcatctttttgacagataaatattcctttgagatgtcagagaaggtgagaaagagaaaatatccggaaccggttatctgacctgaatcactttttcttcgctgttccgcaggcgtgtacgaatccacgtcatggcatcgagtttatttttaaatgccgcaatattaacctgctcgccatctttgaggtgggccctcaggattgctttttcaacaacaacctgccctttccgttccttcgttacttcgacgaccaggaatttctgaatatagtccaggtttattacctgggttccgacatcaagccatttgggcatatatggttccgactatcagggaaaagggaggcgcttattctgctctctgcagaaccgttatttcataatacgatctcgtgcctggttaataaactctataccctctcgcctgatatcctcgcagatctgcatgacctctccggttatctggtcaagttttcgcccaagatgctgtcttccttcctgggtgccgatgagatcactccctgccgccagtaattcgtcaatacccttcccgatctgacctgcagcagaacggagcctggtttcaggatcttccttttggtctgcagaagatggttcaggagctgcatcctctacccatcttcccttatcgaaatgtccccctgactctcccatactactatgtctctttagtgaatttatcaatccttgtgttagcacatgctcttttccggtcggcaggttaaaaatcagacagggatctctgaaccggatcgggatgaataagtccggaaaacctcactccaatcagccggaccggggacctatcccacatctccgtaaaaagcccgtcaatagcgcattcaatcaccctgacctcacgggttggctgcatcagggtcaccgattttgttctcgttataaagccggtataccggatcctgattccgatggtgcgcgagtatatattctgttcctcaagttcatgacataaggagagaatcattgtatgcagtgaacccaggatctcatcaggcgatgtcgaatcccgtaaaaaggtatgttcacggctgatcgatctcctttttccagattcccgaaggccttcgcgatcctgccccctggcaatctgatgaagcctgacagcatgcgaaccaaacatatcctgtaatgtctggatatcacaccgggctatatcaccaatggtctgtaatccggcattgatcaggacctgcgcagattttttcccgatcccgggaatttttcctacaggcagtggttttaagaatgactcgagagtatcaggagacacaaccgtgagaccgtccggtttctgctgttcggatgccatctttgcatagatccgtgaaggggcaagtccgacagagcaggtcagtccgacctggtttcgtatcacctgctttatattggcagcatggtgtgcagccagttcatatgaccggtcacaactgagatcaaggtacgcttcatcaatagacacctgctcaatctctccggctatcccccgaagtatctgcataattgttgctgaaacctgcgcatacgtagccatatggggagggataaagatggcatgagggcagaggtgataggcctgtgatatcggcatagcggagtggataccaaatgcccgtgcttcataggaacaggtgctcactaccccgcgacccgtcccctgcatgggatctgcaccgatgactactggttttcctgagagatcaggattgttccgtatctcgaccgaggcataaaaagagtccatgtcaagatgcagaatgatctgttcgttcatcatctccgggtgtattcgtatcaggttctcatccatgatgtttgagcctttgtatacctgccaagaagtcttccgcgaaagtgaagcacatttttttaaaggtcataattggcaccatgagagaaattacgacaggaaatgacccttttcaaaatcatgaaatcgtggtttttcactttcaccctgtttcattaaatttcaaatacccctggacatgacctgtatagtgtgcagaaacacaccggagcggtacccctgaaacataaccccccaaaccccccacatgccggatctccgcacccggcatatatctgctccggaagcacaactgcacacaaatataccctatatatccccatcccttaaccccccacttttggttttttatgaattatatcaaagacgaatgctcatgaccttatatgacccatatatgagagaacaacaccgcccagccgggcaataattttgatatgaggaaaatatgactgaaatcaatggttccggatgcacgccggataaatgtcagggttgtacaggttgtggaggagaagcaattgaaaagatcaccctccgggttgaatggaaacataaaggtgtaacccccgaagaccctgaagctatctctacgatactgcatgacctgtccgccgaactcatggtctccggtgtggagctgatttatatcaataatacctatgaagaaaacataaaagagaattcatcaacattcttcataaacgggcacctcctttctgatattgtagaccttccagaaggcccggtgtcaaaagaactcatccgtaagggtattttccaggcacttctccggaatctctgagagataacccttatcttattcttattctataatcaccttcaggtaaaaccatggagaaaaaactcctccctgaatttgaaggataccggattttacatgagcatgggatatcaataccggattactcgtttgttacttcccatgaagatgcactgaaggctgcagagaaactgggatatcctgttgttatcaaagtcgtctccccccaggtaattcataaatcagatgcaggtggagtggccctgaatctctcctgtcctgatgccattcaaaccgcgctggtacagatggacaaccgggtgaaagccgcagttcccgatgcagagatatccggatacatggttgttcaggaggtcccttcagggactgagtttctcataggcggaaggattgacccatcctttggaaagatcatcaccgtcgggatgggtggaatcctggtagaattactccatgacttttccatgagggtgttaccggtctcacctgatgaataccgggagatgatcagggagatgagcgggtataaacttatcaccggatttcgggggagaaaaccacttgatgaagatgccctggtcgaacttctgcaaaaagcgggtacgatgttctttgaagatgaccgtattattgagtttgatataaacccggtcattctctatgagaaaggagcatatgcagttgatgcacggatgtacgtgcggtcaggggaagtgcctgagatacaggagcgacctgtgttgcccccggttcccgatattctgcacccaaaatccatcgcggttgtaggtgcatcacgaaacccgggaaaagtcgggtatgctgtctttcgtaacctcctgaactttaaaggaaaactctacccggtcaatccccaggcagaggatatccttggtatcccggtttataagaccctctctgatatacctgaacctgtcgagatggttgttgttgccatccctgcaccaaaggtccctgagatcatccatgaagccggatccaggggagtaaaggttgcggtcattctcaccgccggctttcgagagaccggggaagaagggaaaaagatagaggatgagctacttcgtgtcgcacgggagacaggaatcaggattgtcggtccgaactgtctggggattatcatcccgccactggaactgaatgccacttttgatgtccagtcccccctgtccggtcagattggatttatctcccagagtggtgcgatcattaccaccgtccttgactggtccatctcacgccgtatcggcttttcatcggtcatcagtgtcggaaaccagagtgatatgggatttatggagtatctgcaggttctggaccaagacccgaccacctatgcgataatcctgtacgttgaggagatccgtgacggtcgggaatttatacgatatgctgcaacgatgcgtggcagaaaaccggtcattgcattgaaatccggttcatctgtccgtggacaggaggctgcatcatcacataccggttcgctggcaggaagttttgagacatacattgctgcgttcagacagtcaggcgtaatacctgcttattcattgagtgaagcctttgatatcgcaaggctggtggtatcagaggggtacccacggggaaaacggacgatcatcctgacaaatgccggaggtttcggggttcttgcagcagattatgcagaaagctacgggcttgagatgatcaatctgcctgaagtagtgttcgatgagctaaaccggctgctccctgatctctggtcacataaaaatccggttgatctgcttggtgacagcaatgcgtcacggtttgcccgcgtctttgatatcctgataaaataccagaatttctgggatatcgcggtggtcattaccgctccggtcgccctgatggatccgaaaaatctggctcatgagatgattcgtctctcccggtttaccagatccatggttgtcgggtgtctccttggtggagattcaatgaaagcagccatcgatatgctgggcgaggctcacataccaaattaccaggatcttcaggatgccttcagggcagttggttcaatcatcagctcctgtgtgatagatggttgcaatgaagaagagtaagaataattaattttttgggagcggtttcagaccgccgagagtgaaattaatctctttttgcagttcatcatattcctgctgaagacggaggagaaaacccgaatactcaataggtccgtatgtttcattatcttctgaagggttatgattcccgtatcgttcttccaggattatcaggagtttttgtgcgacttctatcgtccgatagagccgtgcaagcctgcggatcttctcctccggatacccggcgcgcaatccatgacttattatttcttcaattgatctgactttgtccaaagcactggtgatatgatcgatacaccgctttggagtgataggtttcatgatataatcttcaatacaataggagaactgctcagcttcacggtaggtcaggtttttaccggtctgcatgatgaccgggatatgtttgacctcttctattcgtttcagccggttaagtgtctcccatccgtccataggttccatcatcatatcaaggaggatgagatcaggacggtactgagtactaaggagatccagacactcctgcccgccaagaaccccttcagttttaaacccatatttattgaggcctataacaaacaactcatttaaggcgggttcatcatctacgatcagcacgttcggaggcatgagagtacctgtctaatgtcacttgtatgctatccagtgcattaaataataccggatgttgataccgggagaaacctccccggataggaaagatactgcaccggagccttatatgagtggtgcaccacattcagggtgctgaaaaagataatcaaactcatcttttgaagcgatatcataatacaaactgaggagtgatacaaagaggcttattaccaaatcttcttggacgaaggaaaaagacatatggttcaggatacccttcaagcactctgatgaaccgggttttatcaacgtatacatatccctcttcccgaatcatgtggtaattactgataccgtagggaatcttcagaaggggtattgatgttattacttgatctttcatctcatttatcatctatcggtacggtgtctcccggaacccgggttcattttgtgaaccctcatgtacacgaacgtgcaacacacagacaaagccagaccgtttatgatcaggtatataagaggatgagtcatcgtctgaccgataagatttgcatgcactgccgcaataatcagggcagggtacacaagaatatgaatatatctccaccggttcttcagtgccattctgaccaggcctgcacaaaaagccacatacagaagaattaaagcagtacgtccaccggtggcaaaaaaggcatataatgatgagaagtcagggataaacactccgggatcaagagcaagatatgcgtataataccggatgaatggtgatcagaatcagaccgctgatagcaaaataatggtgaattctgataaagggtctcccgaactgagacttcaccgcacctttcttcaggttgagcagagcaccaagcgataatgagataaaaccccatacccccgcaatacggaggagagtatataatgaccaggatgtttccagtccggctatgacaagcagggggattccatacagcaccagtatcccaaagagaagcaggaagcgacgctgagagtgcatatagtgtatgtcgtcccatatccgtatgatacctgcggattcatccatggagaatatatgaatcctgattccattctctaagggaattgtatggtatgagagactggaacaccgcagacctcattcatttttataccgctcttcgtgatgctcacggactgcagcactggtggccggcagatactgcatttgaaacaataattggcgcgatattagcccagaatgtgtcatggaggggagctcgccaggcggtgtgtgccctacaggaggcagaccttatggatgcagatatactgtatcaggctggtcaggataccattgctcccctgatccgttcctcccgatattacaaccagaaagccaggaagatcatgacatttctgagctggtttcttgagacctgtgatggtgatgtatccagaatggcatcccttccgactgatcaggtcagagaggaactcctgaacctctccggattcggaccggagaccgttgattcaatcctgttatatgctcttgaaaaaccagtctttgtggtcgacgcatatacccgtcggattggatccagacagggatggtttgaagatgatgcatcatatgaccagatgcaggagtttttcatgaaccggttatccccggatgttccgttatacaatgattatcatgcccagatcgtgtacctgggtaataaactctgcaaaaaaacacccttgtgttctatatgtccggtacgggacacaggcagtacccggtgtcagtatgcaaggcccgaatgaatataacaaaattagagtcttattatgagtgaatatctggcaattcttgccttctctccgtcagtcaggtataccttcggaagattctggccattaaaaccaggacagatacttcgtcttctcatcatctccttcttcatcggggcatggattacgagtccattcccccaggatctctcgtatggcgacttctcctggctttccgggctatcaggcgggggtaaagtcatgaacgaggcatccctgattggaaccgtcatgagcggatttctgttgatattactcgtatatgctttcttcagctcaatctttcagtttatctttgtcgattatctctcagcaaaaacgaaggagttgctcccttcattcagggcacgtgcaggaatgggtatcaggctgctcggattttacctgggaaccattctgatcatcggcatctgtgcggtgattgccatcacgggtatcgctgttccggttcttgcatctcagcctgacaatccggcagcattcttgatcgccctgatgtacgcattgggaggacttcttatcctgataattccggtctggattctgaccattatcacaaccgactttgttgtgccggttatgatcgttcatacctgtggaatcatcaggggatggaagatattcctgcaggagatcacagggatgtgggatgagatgggcatatacctgatgatcaagatagggattcatattggaacgggaatagtcctgggtattcttatggttacggtgatggaaggacttgggttttcatctcttctaatgatacccggattatcaccatctcatgacctgctgagcaccgcatatatcctgccatttctcgtaatggccgtgataactctcatggtaatgactccggttgtgacattccttcgctattatgccctggtatttttacatctcctgtcagagaaatattccctgctcccggatcagaacccctgaacagaagagggcagtacctcaaaccggcatataagagagaagggatcataccagcaaaacaggggaaccaggatgataaggataagacagagaccaagaaatatcagatctgaccggagaaatggcttttctttgataaagatataactgtcacgcccatatccccggcagagcatactggcataggtccgctctccctgctcaagggatctgataaacagtgatcccatcatgtatcccatgttcacaatacgataccggtaggggagccggtgatcaaatggatcaaataaccgggtctttagtgcatcggtgaccttccggtagatgataccaaacacaaagagatacctgatcatcatacccagagccagaatgagttcaggagggactttgagccgccctgctgcctcaagaagatcctgcaatgatgaggtcgaggacaaaagaacgataaatgagtaacataccagaaattttaccagtaatatcgaggcaaattcaatcgattcaaaatatatatgaatccccaggggtagttcaaggagtgaatggtagtcagtgtaatatcggtttttaaaaaaaatctgaaacccgcagagcataaatccaaacggaagagcaagaaggagccgtcggaaatagatgagcggagagatttttgataatgcccagaggaggagaaacagaagaaagaagactgctgatacggtatagacaaccggtgaatagggaacggcaacaagagccacaatagcagcacaacagacgatgatcttcactctggcatcgagggaatgaatgacactcttctgtgatgtcacctgctccaggtcaaacaagtcttctatcatgcaatcttaccaaaggcctttaaaaatgcgatctcagcctcctgatacgtgtatcccatatcaattgcaatgccctttgaccggagtgaagagatgagtttgggcaggatgggaagatcaaggcggacactggacaggagatcgggttgtgaaaaaatctcggcaactgttccttcggcaacaaaggatccattattcataacatagatatattccgccagttctgcaaccagggagatattgtgggttgagaagatcaccgtcatcccgtacctgacggaaaaatcacggataaacctgataatctccctgactccctgcggatccagtcctgcagtcggttcatccagaacaaggacctggggctccatcgcgataatacccgctatcgcaaccctttttttctcaccgccggaaagatgatgaggaacccgtgtccggtactctgaaagaccgacggtgcgtaatgcttcagaaacccggtgctttaccgcctcttcatcaagacccatgtttatgggaccaaatgccacatcctgctcaacggtaggagaaaagatctggtcatcagggttttgaaacacaagtcccacagtccgtctgacctcccgaatattctctttggttatcggctctccccgtatcaggacttttccactggtaggctttaagacaccattgaaatgtttaaagagagtactttttccggctccgtttggcccgatgatagcgattcgagtgttccttggtgcaataaatgagatatttttcaaggcgtcgatattgcctttataggtatgacagagatcctgggtctcgataatatgcatggtgtggttgtctcctgctctgaaatagcagagaacctggattggatcttcaggttttcagtattatggattacagctcaattaataaaattatactgatcttattttcgtatgaaaagggaagaaataaaaaagaaaattattgaaattgtaattattgggagtttttactcaatcgtatagcatatgatgcacccatcacaatcagcatggtaatgatggtcccgacaactatcgcaataatacccccggttgaacccatctcttcaccaagagagtagtcaggcatcggtgattcataggtatacgaaccggttccaatcacttcaggatcaccttcttccggagaaagaccagtcagttccttctgtcctgataccacaagcgcagtgctctcaagaccgtccggatcgccggaggcaaggaatactgcaaccattccgataagaagagagatcagaagacctgcaataatgaatgtcttattatcaatcatactgatgcaactcctacagaggtatcaacaagatcaggacgagccatggcaagaacatagatgatgaccgcagtcactaccccttcaatgacaccaataattgcatgatagattcccatagcaacaagtccggggaccagcgggaaggtccctgcaatggacatctcaactgcacaggcaagtgccgggataagacaggccagccatgctgcaaccgcacttgagagatatggatttttcacaacttttaacagaccctggaatgtgtaataccctacaaatccacctataacacccatattcaggatattcgcacccatgacggtgataccgccatccccgaaaataaaaccctggatgataagaacaagtgtcaggataaagactgcggcaaacggtgacccgagaacaatggctgccagggcaccacccacgagatgaccactagttcccatcgaaaccggtagattaaaactctgcagtgcaaagatgccggctgcaaggactgcaatcagggggattttatcctcgtttaattcagaccgtgcccaccggatagcaagggctagaaatacaagggcaataatccagtagactgctgcctgaggaagtggaataaatgcgtctggaatatgcatggtataaccagcataatattagtacgattattattaagatgttacgaaattattacgtttttacaattataatgaaaagttaaatcatagattataaaaccggttatttcatgaaatcatactacctgaaaaccggtatttaccttcaggaataagaagacagaatctggcaccttttccactctctcctgattcgtaaatggtaataccggagagggagaggatctccttaattaagaatagaccaagaccggtgttctttccataccctctctcgaaaatccttgtttttgcatcatctgcaataccggcaccgtcatcctcccacaccagcaaaagccggttatccggttggatctcataacgaacggagatggtgcttacattcaggccatgacggagcgtattgtcaagcagattttcaaagacttttggcagaagcggatctgcatacatctcaatggtatcaagttctatgttcacccgtttcccttcaaagtcaagttttctgatgatatcaccaggtttttgccagaccggggagtggacaccaatatcctgataatttcgtgtaaattcgatatgcctctggataaacccgaccgcgtgagcgattttttcaaggaagtgttcaatatcaggatcaattgaatactcctgaaggagagccaggtaactcattatgatatgaacctggtttaatatgtcatgtctggtcacattcgagagcaggttgagttttttgttcgctgatgccagggcatcaacagtccctttcaatgtctcggcatacctggcaaggtcctcttcattccgtttccgttcggtgatatcggtcaggacagccagaaccgccgggtttccctcatatagaatactggttgcctggacttctgcatcaatgaatgagttatcagacctcatgatcctgacttcatagggctccagcgtctccccccggatccttttttcagactgaaccttcacgaatgaacgcatctcgggagggatgaaatcaaggatgttctttccgataatatcaccattcaccgtccgcatggcccgaagagaactctcatttacatacaaaatggtcccatactgatcatagatcatgagatagtcgggaagactggttacaagtccccggttaaagttctcactctccagaagtttctgctcactctcttttcttctggtgatatcagtaaccgctccggccatactggttggaattccggactcgtcataaccggttatcttccctctcagataaacccagatatacccttcctttggattttttatccggatctcatgcgatactgcctcatgcaccccctgtgaaagtgacgcaaagacggattgtaacataccccggtcatcatcatgaacaaaccggaggagatcagaaaggggatattcctcctgatccggggagagaccaagcatctgattcagacgaggcgaaatagtgatggtttcgttgtgaacctggtagaagaaaaacccatcattactcgcatccataatccgggcaagtttctgtgtcatccggcgaagttctgattcgatctgatgtctggcggtaatatcctcaatcagaatataaaacccgtctcgcatcccggagactgaaaaggtaactggcgtcaccatgattctgatatgcaggatgtcagatccggttgtccggaaattgtgaacagacctgatccgtgatatatcataggtcatttcagccgtgaatgcttcacggttctcaatcctcttcttgattgaatcggggatatttggatcatccttgtaggagtatctgacaagatcaaggggatccaggatgccaaacattgacaccactgccgggtttatctggatcatggtgtcatcaggatcaaagaggatgatgccgatcgggcaggtacgaaagattgcattcagccgctcttctgaaagacggatctcttcctgggccagcatagttgatgaaatgtcacggcagaggcagaaataggcttttttcccattccatgaaccagatgtaattctggtttccatcactatccgtgaaccatccgcctggggaacggcatattttatcggctggtaatcatatgctgctttttcaagagggagtaaggtaagatacggggtctgactttcacggattggacgcccaatcagttcttctttataaagacctgtttttctgacgacctcctcatttatcgcgaggatggctgtggtggtttcatcaataacaattaccaggtccccaatcgattgaacaagattttcaaagtttttccgttcttcgaccagttgtttctgatcattgagacgttgcagtccgtttccaatctcccgtccgataccaagcagaacctcctgctcttctatcgacacacgggctggtctgctactggtcagatgaatagaaccgattattctctcaccagagatgaccgggataaatactgatccggcaataccccacttttctgcaaattcgggcatgatgtatgagagattattggtaaagagtggttttccctcggtatagagaaaggcatagtcttccggatttatctctgtggtttcaagaataaactcctgggagagtcctgaatttgctaccatcaccggtgtttttttatcaccggagagaaggtagaatgcacctccttcaaagtgcagaacagaaatgagggctgataatgagagatcacacaggagagaagctgaaccagccttgcctgaaagagagatgatcctactgagtatctcaattttccgtgcataccggcgtatctcctcttcctgatttcgaaaccgggtgatatcctcaaatgcccagagtatccgttcttctccgctctcttctgaaagtcgtcgggaaaatcctcttattacccgttttcccggcagttcaatatccctgcaggagatatcagggtttttacagacatccggattccatgtgtagaatggatgttccaaaaatcctgtcgatacagagagaaagtcctgaagcgtcggtgtagttccggttctgggcagatccgcaatgatatcagggccccagatatcgaggaaatgtttgttgtggtataatatttccatatctgtggttctggtgacgcatatgccaaaggggagcatgctgacgatctcggtcaggagagattcggtccagcgaagacgcttttcggtctttctctggtaggtgatatcccgaaggatgcattggatatatagaatattcccctcagtgttcctgatgacacttccatctaccaggacggttaccggggcattttctccgtcaatcagtaccagttcaagactgtgtttttggttggaattgagcacctctgtcagacaggcaaaaaacagttgttttgattcatctgtaagaatatcgttaaatggaagaccgataaccgactcccgggtacgcttcatcagggagagccaggcccggtttacctcggtaatcctcccatcagggctgatgaccatatgtccgatcggggactggtcaaagagaatcctgaagcgttcccgactctcctgaagctgcatttcagccctgacccggggagtaatgtccctgaaactatatacggttccgattattcgtccatcacactgctgtggacggatgaatatctccaggacccttccgtcaggacagtgcagggtgtgccgcctctgtgaccttggctcatctttggttttggcaatctctgcaatgagagatgagtctgatatcacatgggagaaacggtttagaaactcctcaatgtgggtgtttttcaggtcatcagaagagatgtcccataaaagtaagaaccgttcattgaaattggtaacatacccttcccggttggtgaccagtataccttcttctgtcgcttcaagggttgcccggagctgggaaagcatccgtctattctctttgagactatttagaagtgcttcatctgctttcttcttctcaataagagagagaatctgcatcttcagcatctgaaactgaagagcaggatcctcacctttcactatgtaaaagtctgccccaaggtttaatgccttgataacaacctcttcacttccccgtccggtgaagagaataaaagggacggtattgccctgttcccgaagaagtgagagaaaatctatgccatttgttcctggcatctgataatcagagaccacggcagagatatcatggtgagtcatcgcctcaagagcttctccgacggatcgtacaccaataaccgtgaaatgttcatcctcagagagatactgactgattactccaagaatttcctcttcgtcatcaacagcaaggacggtaattctctctgcagacagcttcattgctacgagatttaccagattatataaataagtattccagatactggaagggttttcgatccggtcaggtggaattcattcatgtaatcagaatacaaacctaatactcgtatgagatcgaacaagccagggcttctcctgcttatcctgttcattatcactcaatgcgttctgccggttcaggcagttcctccacttcccgcagaatattacggaaatgtcctgatagacggggcaccagccccggttggaacgactatcaccgccttcatccggaatatcccgaaaggttccattgttacggacatagatggcttttacggcggtccgggcctctttgatcccaggctgaaggtgaacctgaccgaagaagaagttcaggcaggagacctgatcatcacatttcaaataaatggtatccctgcatcacaatctattctttttgaaccgggtgcagcacagcagcttgatctctttacaggagaaccgaccggggagatatctgctccggtcatgacacccgtaccagtgcagactgaaaccccgatgggaacaccgcagacgggagataattataccgagcctccggagtctgattcaggagctgaaccccccatacaatacggacttgaaagagatgaaaaattcacctctgatgatggcatggctgcgattgcgttcaataaaaatactctcctcttcgcaccatccggacagtttctcgaggaggtcaatgtcagctcacgaacgatagccgatctggcaccggtcagtacaaaccagtcactgatgttctccggatatgcatatgagatcaccccggaacgaacatactttaacccagaaggcgtgttttccattcagatccctcttgagcggatatcagacctgatggcattaaacccccagatctatcggtacttaccacagacggcatcctgggagcaggtccggaccacatcaaaccagtttaccggtgttgtaagtgcagcagtctatgaagcggcaatatatgccttgttccttgaaagtaagaatgcatatgccacaccacaggtaaccaaaacaactgtcccgccaacacttgcgccaattgccggacaacccccggtaccgcagaccccttcctatccacccccaggcccggcttcacagggaccggcaccatactccacggcatatcaggaaccatatacccaggcagcaatggtgacacaagtgccggtaatgccggctgttccatcggaaccacccagcccagggggaccggttcagacgcctgtgcaggagagtacgccacagcccacggaaacatcacagcccatgccggagataacagaggaaccagcagctccggtcacaatgccgtcaccattcacgttctttgggggtcttgtggattcagtgaaaagatccctgactggaccggtgggtctgatattgggtctggttctcctcattatcatcatcaatgcactcgcgtatctcatctacacccggtggtggctggtcagagatccatgaatgcaaaaaaagtctataccgccgccacggctatcagggacatccaaagagggcggcctgaaaaggccttaaaaccccttgaaaaacttatcaaagacgctccggacaatccggcattatggaacctgaaaggagtggcccttgggatgataggggatcatgaaggatcacttgcctgttatgagaaagtcctcaccacagaccccggccctgccgtgtattggaacaataaaggtctggctctgcagaatttgggacggtatgctgaagcggaggagatgtataaaaaggcacttgagcgtgacccggagtcccttgaggcacgatataaccttgcaaatacccttcagtcactcggtcggttcgaagaggccctggattactacgaaaaagtcctctacgaccggccggatcatatcctgaccatgctgaatatgggaaatgcccttgcagcactacaccggtttgaggaggctatcgccatgtaccaggagattcttgagataaacccggaatattctgatgctgcatataatatcgggcatacgtatgaagagcagggggatttcgataatgctacggtatggtatacccggacactggagatcgatcctgactaccatcatgccagggaacaactcgatctcctgaaaaaaagatgatcaggcagaaccaaaattggatagtacatggacatagacatccatgcactggttcagcatccggataggaatgttctcattgatggcatggaggagagagaggtcaccaggtccgtaattaatgacttcagccccggtctccctgagatgccgtgcatcacttgccgcctgggtgacaccaggcatcgccttttctccatgaactgactctatcccggcacataccaggtcataaagcctgcctggacgactaagggtgggagcaacacgttccagcacatcaacactactatgtgaaatgtgtgattctatcattccgattagcagggggatgtcacagccccacgggattcgcatatcaagatcaagttcgcatctctgggcgatgacattgatacgctctccgccggatatatgacctggattgtatgacacccggctgagaatttctgctgcttcttcttgtgatatcgaaagaagggatgagagtgagtttgtggtattgttaatcacttcggacaccaggggatcctgtgaccaggtcatcgcgtgaatctctttacaatactccaaaaacgagcatgcctgcattatggcagagttaccgaccaccggatgcagtgacgaatggccggcatctccggtaaaggtgatatgaagtctgacaatccctttctctccgatgactggtgacaacacaggcgtaggctctgctatcagacaggcctgtgggcggagataccccttttgaaccagatactccataccgaaatccccgtttccctcctcatcacagacaaaagcgatatcaaccggtggttcgatgccatcattcagcactttttgaagagcacataacagagcggcgcagcctcctttcatgtcagtagagccacgtccgtgaacgaccgtatcatctatcctgccggaatagggaggatacgtccagtcatcaggaagagcggggacgacatccacgtgcccgcacaagagcaacgtattctgaatgtttttagacagaagattatgttttcgcccttttttcagaacctgagtttctatcccgatatgtgagcagaactcctgcagacaggagatgacctcgtcggtgtacccagggggattttcggaacgaatttttaccagctcagagcagagacgggctacatccatcatcagttacctctcagcacgtgtccatgtactgggcatacaggtgtgccattgaggacccgttatagatggaggccaggtacgccttatcaaagacctcatcaatcatcatcattaaaactgcaggcggtgttggttttttgtcatttggatcaaggacaatcctgaatgaacgatacgatgccatatcagagggatcataaatcttctgaataaagagcgggaatttctcatactcgtccggatggttttgacgcagccaattcatgaatccgtcaaaccgtgccagatttccctccagagtcttatctttccggcatttcatatattcacgggagagcatattccgtggtgagtccgcattgtacgcaaacagggagatggtgtaatcaagatgtgccatggcatcaaaataccagaaactcaggtcagggtgaaaatccgacatgttctccagtatcagggatttttcatacaaggtttttagaaccttttcatactcgttattctcaagcatgatcacaagattggtgttcaaaccataaccatttccgcatagctacttattgtatggctctctcttctttgccgctgccagaaagagttgctgaagttctaccccgcgtttgcccctgatatcaaccagattatcatccctgagcagacagggtttgagttttccgtcagatgtcacccgcatgcgtgtgcagtgattacagaagtctgaattgtgccagggacggacaaattctatctcagcaccttcatagcagtattttttccgatgatgcatcctccgggtgatgaccttgcgcgaatgaagagcaatcttctcttccagttctgacaggtcggcatgcaacgggcatcctcccaggtccataagctcaatgatctgcaggatcaggtgccgatcaccggatacgagatggatgaaatcatcgatctcaccctcatttatgcctttgagcagaaccatgttgatcttaatcggcgtgagcccggcatcacgtgcggcttcaatcccctcaagaacgtcagataacaggccggttccggtaatactcttataagtttccggatttaaggagtccagactgatattcacccgggcaagtccggcatccctgagatcatgggcaagagatccaagaagagttccattggtcgtcatcgaggactcaatccctggcggaacagaacggataatctccacaatgtcctcacgaagcagaggctcccctccggtaaatttgacggtcctgataccgatgtttcccgcaacgtccaggattgctctgatatcctcaagagacagcggggtttcaggtttcgtctccccttcccggtgacagtatacacaccgcagattgcatcctgagtttaccgaaatacgcagattagagatgggccgaccataggaatcatgcagatccatctgaaactgactcctctaacccctgatgagtgccgatgaaattcttcgcaatgatatacatttcagtacttcctttgcgggtggtatgcgccttatatgtccgtaccgagtaaaattcctgttttacccggttatacagccagctaaaatcctctccctggaatgacttcataatcatgttcccgccctgcttgaggagctgccgtgcgacaccgagcgccatctcattcagctcgatagctcttgcctgatcaaatgaccgctggccggagagctttggtgatgcatcacacacaatcccattcacttcaggcataagttcccgaatctgtgcaattactaccggatcagagaaatcaccgatgatggttctgaccccttcgatgggcagaatgggattgagatcaacaccgacaataacaccatttgtcatttcacgcaaaacctgcagccagctcccgggagctgcaccaaggtcaaggatattatcatccggacgaataaccgggtttttctgaatgatctccttcagcttcatcgccgcacgcgaacgataccctgattgttttgctttcagatacgctttatctttgccccattgtgaacccataaaaattatcgacctggactttcctcaataatatgcgaacccggcacatatatctgtgtcaaatcacaacctgaatgcatagggagcgcagatgctgaaagcaacgatcagtgcagatatattcaaggataccgttgatgccctctctgctctggtaacagaatgcaggcttcatttttctgagacagaagtatgggcacgggcggttgatacagccaatgtggcgatgatcatccttaccttaaaaaaggaggcattcagccagttcgaggcaacaaccggagagatcggtttagatatcgcaaagctgaaaaatacctactccatgatgggaaaggcaagtgatatacgcctggaacatcaggaaggagcaaataagatagaagtcacctttgaaggataccattattcaattacgctccttgactcaaataccatcaaaaaggacccgaatgcaccaggtattcagcttccaggtcaggtgaccatatccggatctgaactctataatgtaataaaatcagcatccatcgtatcagacaagatctggtttgccatcgagccggagaagaaggaatttgtcctgtatgccgagggtgattctgataatatcaggagagcgttttcagccggagaggtaatcgcctccaactgggagccagcaaaatcgctcttctccattgattacctgaaggatatgggaaaagtgatgagccatgccgagaaggtaaccattgatctgggcgttgatcatccggtcaagttctcatttgagattgcgggtggaaacggccaggttgagtacctgctggcaccccggattgaggctgactaaatgcatggtcacccttgatcgaaaagatctggcaaaatatccttttttgaaagaatcccagtcatacatcgggaccatcagtaattcacttgataccttccttgaatctgcaggcgggaggcttgcaatcagggaggcaatcacaacacttgagcatgcgctttccttcacaggcagggaaatccctcctctccccgacattccgaaagatccggaaggagtcaccatcatcatcgcggcatacccggtcagcaggatcatggtctcctgcgcccaggatcggattttcatcgaccggctggtacgataccaggcatggactgtctttgcctttctccaggatgaagacccggaggtgaaacggttcatcagaagatccatcggccttcccgagaccgggaatgagatctctgtagtagactatataccggttgcctcacggatgcctcaagagaagtggagacttatcaaccgggtagttgtcaaagggaatgtgcaggtggctcctgacgagtatgatgagattgtaagagagcgcctcagatacattatggccaggaacctgccactcaaagtcccgtcatctgtctgcgaactgctcaggccggcggttgaaaggattaaagcggaatggcagaagagggcacttgaagagttcggccaggtcgaggagtcggcatttcccccctgtatgcaggcgatactgggggccatagccggacagggacatctgacccatatggcacggtttgcaatctccgcattccttcataatatcggcatggaaaataccaggattatcgaactctacgggtcggttccgaactttgatctccgaaagacgctctaccaggttgagcatatcaccggacggggagggacaagtaccgagtatgtctcccccctctgttcgaccatgaagacgcacgggatttgtgtgcatccggacaatctgtgcaagaaagtcacccacccgctcacctattacaaacagaagaaacgtgacctgaaccggaaaggaaagccatccggtgaaaatgcgcccaaacaggcggaaaaaaggaagagcgaaaaaccagaggggcaatcaggcactgacgcctctgatagcataccctcccgcgctgatagtgatcacaaagaggagcagggcacctagatatcctatttcaccaggaaggactgccgggagtagaaggatgagtacaagaaaaactatgagacttccaactccaactatggcatcaagcatccatcgtttcataacttcagtactttgcgtcatctccccggttaagggtttggggggccgggcatccgatacacgaaacccagggatccaatgaatgaagcattgaaagaaaaaatcagcagagaactccaggaagctgccgagcgaatatctcatgaggtcgctttggaacttttaccagatgagggtatggaacttgtctatgcccgtcacggagcccggacaccggatgatgtcggatcttgccttctctttcgggaggttgaaggaatatcccgtccttctatcaggtttgagcacccatcactcatggtttcaggaatcctgactgcgatcaggttctctccggagatccgatcggcctgcagtatcaggcattcagaaaaactaaagagaatcgctgaggatatgctgcttgagacctggacctgtactgcaggaagtatcccccccggagtctccaccatggactgggcggttgcattctgtagcgagcaggattctggagttcccgatgtcctgttcattgaaacagacggaaaaaccttggcacaggcacgattgtttggtgagagaccaggatcggttgcaacaaatcttattaagatatcacagcgcattattgatgcaactcactgagagagatatatcatgggaattaaaccgacttatatcaaaaaaatcgggattgaactcctggagttccacgaagaaaagtttacgaacgactttgacgagaataagaaagccgttgcaagcgcaaccaatgttccaagcaagcgggtcagaaacagagttgccggatacatcacaagaaagataaatactgggaaattcaaaaaataatcctcatgtttgagggtgttttccccgctttgattactccttttcaaagaaatcacggaaagaatctggaccttgatggccttcgttccaacatagcgcacctcgttgccgcaggggttcatggtgttgttccctgtggttcaaccggtgaatctgcaactctttcttttgccgaacacgaacaggtcgtcgaggttactatggatgaggcaggcggaaaggttcctgtccttgccggcactggatccaacaacacttctgaagcgctccggtttacacgggctgcaaaagatgtcggagcagatggtgtccttgtcatcagcccgtattataataagccaaacaggtcaggtcttattaagcattataccgctattgcagacctggatattcctgtggttgtctataatgtccctggcagaaccgggcagaatattactccggatattatagcagagctggcaaaacacccaaacatcgtaggagtcaaggaggcatcaggagaccttggtcagatatcaaccatcattgaactgacgagagacgaagatttcgccgttatctccggcgatgacaacctgacgcttccaatcctctccctgggcgggaaaggagtcatatccgttgcagcaaatatctatccccgccccctgattgagatgtatgaagcagcacagaagggagactacgagactgcacgggagatccatttcaaatattcacccctcttccgggcgatgttttatgagtcaaatccgatcccggtaaagaaggccgcagaaattctgggaatggctgcaggaccacttcgtctgccccttgacgaggcatcagagcagacaacagaaagactcaaagaggttttatccagatatgattaaagtcgttatttgtggagcatttggccgcatggggaccatcatcggggagatcatatccaaagagcaggatatgcaactcgtcggcggggttgatataaaagaggggacgttctttggagttccggtcgtgacatcagacaagttagcagactttctctcgtcagtacaacctgatgtggtcatagactttacggtcgcaccggcagcagcacaaaatgttccggttgcagcccgagccggatgtgcaataattcttggaacgaccggccttactcaggaacagcggaaaggaattgacgccgcgattagagagggaaaggtcccggcggtcatatcaaccaattactcaatagggatgaacattctctggacgcttatcagggatgctgccagaaaactttcagattatgatgttgaagtgatcgaggcccatcaccggtataagaaagatgcgccaagcgggacggcccggaccatcctgcagatccttcaggaagagatcggcccacgtgaagagatatacgggcgcgaagggatgactgaacgaagctcggagatcggagtccatgttatccgtggaggagacattgtcggtgaccatgccgtcatgtttgcaagcaatttcgagaccgtcactctctctcaccgggcatatgatcgctccgtgtttgctgaaggcgcagtcagggctacccgctgggtatttggaaaagaaccggggatttacggcatgaaagacgttttaaacctttcatgacctttcgaaacctatttttaagtatttcaccaaatttttgaggagatatcaatgaccgcaattattgataaagataaatgtaccggttgtgaaacctgtgttgatgagtgtccggctactgctattaccatggaaaatgaaaaagccgtagtaaacaatgaactgtgtgtcgactgtggctcctgtgtcgatgtctgtccggcagaagccatcaccatggaataaatcccacttttttctcactcattccctttggatcatccccggataattgacacttttacacctgccctgcacagcattcttcgtccggacgaaggtatatcgtttgtttcactctgattatcctaaaaaccaatgtagtgcactataattactggttcagatatatatacgaggtatggttagtgttggagtcctcggcgctaccggcgctgtgggccagcgttttgtccagctcctggctgatcacccgtatttcgaccttacggttctgaccgcctctgagcggagtgcaggaaaaaagtatcgcgatgcagtaaactggcgacttgatcttccgcttccggaaactgtcggagatatcacagtcactgataccagggccgactgcctgaaaaatgtagacattgtattttcagcacttcctgctgatcttgcaacgaaggttgaggcggattgtgcaaaagccggtattggtgtgtgcagcaatgccagttcccaccggatgatgcctgatgtaccccttgtcgtacctgaagtaaatgctgatcatctgcggatgattgaattacagcgcgacgcgggaactgacggattcattgtgacaaatccgaattgttcaaccatcatgctcaccgtctccctggcgcctatccggaactttcatttcactgacctcagggtcgcaaccatgcaggcgatctcaggagcaggatttgaaggcataccgggaatgtccatctttgacaatgtcatcccctatatcggaggggaagaagagaagatggaacgcgaaaccctcaagatcatgggaacatttgacggaagcgaagttgtaaatgccccgttctctgtcagtgcaagttgtaaccgggtcccggtcattgacggacattccatggcagtatggcttgatatcaaggaaccggtggagacagttgcaaaagcattccagaactggaagtgcccgctgaaggaccttcccaccttaccagagaagtcagttgattttatgacccagcaggatcgtccccagccacgtcttgaccgtatgaaagggagagggatgaccgtctctgtcggaagactcagacctggtatccggtacattgccatgggacacaataccatcaggggtgctgccggagcctcagtcctgaatgcagaactgatctgtgaccgcgggtacctgtaatacctatggccagcatggagaacgacaatatcgtatttgtgggcaacaaaccggtcatgaattatgttctggctgttgtcacacaatttaacaacggagcaggggaagtaatcataaaagcacggggaaaagcaatttcacgagccgtggacaccactgaaatagcgctgaatcggtttttgcaggatgtggaaaaaaaatccatcctcacttcaactgaagttgtcgacaccgaaagtggaaaaacccaagtatcatcaattgaaataatcctgatctccagaaaataaacaacgtctcttttctttctgacaaaagaatttaagcagctattgctaaaccttttaagaatgaagatcggtctggtgatgctgatcgggtacttcctgatcctggtgtcccagtcatacgccgccacccctgattcagaagggtaccttcgtattgagtcagttacgatatcattgatgcccgggtatgccgacgttcacgtggaatacgagttggaagatgcattcagggttcttgcatttatgtttggggaaaatgatatcaaatccaggcttctgcaaaaacttgccttctccaatgtaagtgtactctcgatgaactatacggcagcagacctgcaggtgtatgatgttcagccggtttatggcgacggactgtactggttcccggcccacagtttcggatgtgaaattccggaggtcgtgatcagcaccaatctgtcaactgaaaagtatgagaatatcagtgccctggaaaacgggattgtatattactaatacatccaaacaagtactatggcaccagatctcatcagtttctctcttttcgccctttcatccatcctcatcgtggtaaatcctcttggtgccctgctggtatataactccattaccgagttcatggattccaaagacaaacgcaaggtggcagcctacgggtgtcgtattgcaggagcagtactgatatttttcaccctgttcggctcatccctcctgtcactctttgggataaccatcagtgcctttaccgtcgccggcggggttctgctgtttggtattggtatggagatggtgtatgcacggacctcgcgggcaaaggtaacggcaacggagaaatatgaaagcatcgatgctgaggacatttcatcaatgcctcttgcatttccgatgatatcaggacctggaaccatcacaacagttatcgtcctctctcaggataccccgatattttctgaaccggtggaacttgggatcatcctgggctcagtgatcgtgaccattctcatcacctatattgtactgatatcctctgaacagataacaaaacggatcggccagcgtgaataccgggttgtcaaccgtctgatgggcattatgctcatggccatcgcagttcagtttatcatcaacggaatctcgcaggcatttccgatgctgaccggttcagcaacctgaaccttttttaaaaacgggttttacgcttcttccattgctgcatagcactgccggaagagttccctggtttcaagagcctcgtcccggttcaccttctggatggcaaatcccacatgaacaagaacaaaatctccaaccgaaacgtcaacaaggtcaatgcggatatcctgtctcaggcttccaaaatcgacaagagcagtattgtcatcacgaatctcaagaatttctgcaggaattgcaatacacatatcggttaatcctcttctccgggattatcgtacccggtttatgatcattttgtatccgtatcctatatacctgtgtaaagggtatgtatctttacggtatgcagaaaaaaaggacctttcaaaagcccgtgattgtgatcagccggtgtatcgagcatgatccggtcaggtataacggggatatgatttcaagcactgaagttgccgctatgaaaccatatgtcaccttcatcccggtatgtccagaggttgagataggactggggattccccggagcagtatcaggatagtcagaacaaaggcaggagaccggcttatccagcccaccacaaatgaagacctgactgaccgcatgaacacatttactgagggatttataagcagtctcccatccgttgacgggtttatcctgaaaaacaaatccccaacatcaggtatctccaatgtgaacatctacccgtcagttggaaaatcagctgccattgaaaagggaccaggatttttcgggggaaggatccttgagacgttcactgattatccgattgaggatgaggggcggatacgaaatcacagaatccgcgaacatttcctgaccagaatattcatgctggcagatctccggaacgtcgagtcagtcgggacaatggcagaacttgcaaggtttcactcggaaaataaactccttctcatggcatacagccagagcaggctcagggaacttggggggatagtcgcaaactctgaccggaaaagacctgatgcggtcctgaaagagtaccgccgcgccctccttacagcaacccggctccctccccggtatacctcacatattaatgtattacatcactcgtttggttatatcagtgaaaatctgaatcctgatgagaaggcattcttcattgaccggattgaagcataccggaagggaagacttcccttatctgccgtcaggatgattctgcagacctggctcctcacatatacatccgattatttgaaaaatcagacctggtttgcaccatatccggacgggcttgtgattctgcctgccgaagaactggaacggggacggaatatgtattgacggagaagattttacatcgtctgtaccataaaggtgcagtttgatgagaacgagatggaatccccgtcttttacctcataccatttgtctggagagatcttttttccctgtatataggtgccgtttgtcgagttttcatccctgaccagccacttcccgttaaaatatttgaatgttgcatgctgacgggatacgccgttatattgctgaagaagggtcctgcctactgcatccctgccaacggtatccccatgatgaacagtaattgtggctcctggagacattgaaagcgtgagaggagtgacctccctgatagtcctcccctcatcaaacccgatattggcaaaccgtctgtcaggcggtttttttacaataccttttccttcaatctgccggatggtctttcgttcaaccggctttttccccgagatgtctgaaaagcaccgcatacagatcatctcagtcgcaggattcgccatcccacatgtatcacaaattttttgaagcaccataattacatccgggcattcacaccctggagaggatgacctcccatcctgattcactatctgaaatatgagttattattactttttcttcaggagtaaatgtttctttaataagaaccctggagagggggtgaatgagcatgacctcaacccgctgaccgatactgatacctcctctgctcaggtcctgacagcagtattcttccaccatctccctgacagacgggcttatcatgaggttaatcgtgaacatcagggagatcttctcaaatatccttgtgagcatggcatcgagaatctgttttgctgcgtcaggctggatactgcggaagatgatggtatttcccctgataaaccgtgagaaatcaagactcttcttctcttcaaagaagagagtgatactctcacccgccgtccgttcacgggccagatactccttgttggtctcttcttcactgtgcgagtgctggtatgcattcggacaacacccggagagacggagggtgcagatgataaaacatccggaaaaactgatgagcatcccctcttcggtgattatctgtccgtcccggatgatggtagatatgagttttaatacatcagaatgcgctgattcaatattttcaaagagcacaactgagtatggtttttgtttgatttttccaagaaaactgccattatccattgaggagaatgccagcatccgcatacatgcatcatcatccgagtaatcactcatattcagcgagatcatatcccggtccggcccaaggagcaggtcctttaatgcacatgccagagtcgtctttcctactccctcatgcccggccagaaggacaaatccccgtggctgggagagctccggaggatactgagaataggaaagaccaaggtaggcctggtttaacagattgcatacccgttttatggcatgtttctgcccgaatacacgggcgcccagaaaattggcagcatcttctatctgctttttgtcaaccgtcttccagaaattatcagcaattccggatgaatactggacaaccgcctcatgaagatcagatacagacaatatctcacgccgcaccagggagatcagggagattatctcgttcgcctggagatcatgggttcttttcaccaacaacgagagcgattccttcttttcagactccttttgagattcaaactggggaacatttttcgtcagcgattcaagcagggcacgacgagtgttaagatccggccgtggaaccacaatctgcctgactctggtattatcacgggtataccaggtgggcaaagaggcatcccggtcatgaatccaaataagaaggttgaaccggggatacgagcttccggccaggagtctaggctctgcattctgacaagtacagaacagattaaagaagaatttgtcagaggcggcatagcgttcgtcatgccgggtaatctggttcagaattatggcagagtacgcggtccggttatccacactcttttgtaagatttcaacggtcctctcaagtgatggaggcccggtcttctccaccgacaacacatctcccaggatggcatgaatagtatcaggatccccatgcagatgcgaaaatcctacaaatggttccagccccaggatgatatcatacccctctttgaccaggatggtgcggatataatctttaagccgtaatgtagtgagattgccatctatctcaaccggatacacatccaggatgttaccggtaaatgtaaactgcggggttaccgagagaaatctgacaaattccgtagtccatttcggtaggctgaacatgtgggtcacctgaacatttcctgagatatttcatggcatgataccaattaccggatgatgaaaagaaattcccagtactgaagatagtatctccctggcatttgaagcttattatactctatccattatcttcataccagggagacttggatcagggatagaaagaaggtgtacagaaaaaatccttactttattgccagcatccgttgagcccattcgttctcagggtcaataaccaggatcttatcaaggtacagccttgcctctgcttttgctccacgctttaacagaatgaaaactttgattcgcaaggcctcaattatcgtctcatccttttcaataaccccggtgatgtatttgtctgcttctgtataatccccaagtttcagatagcatcgtgccgccttgacacaactttgcagatggtcaggatgattattacagatatctaaaaatgactgcaatgcttcagggactcgttcgattgcatacaaagactcccccttgtaaaacaacgctttgggaaggccgggatatgtagcaaggatcttatcacatatctcgattgactcccagtacctcttttgtttgaaatacagccgcgcaagaccgatctgaggtacaggctgggcgatatggactatcggaacctgaagatatttctgctcagccaaggctgggtttccagtctcctccagatgttcaccggtaagccaggtgatgaagggatcatcagatgtctgaatgactttatgtgacaggcaaaatccggcttcatgactccgctttagtttaaaaagactcactccccgcattgcccaacccacagcaccggccttgtccatctcaatcagacgctctgatattgagagagcaagggagaagttgtcctcaagataatactggacatacttctctttccaaaaagttgcagtttcattccagggatcagacgagatggagataaggttcttttcatactctcgggtcagggcggtgtaaaacctgaacctgggcagaccttttctcttattaaaaaggagcgtaagaaccctgatatcaaggttgtaagccttcttcagaagaagtttaccggacttttcatcctgcagttcttcaaatgcagaggcaagggcaacaaggagatcaggctcaatcacctgggcggccagggcgtgttttgccgcagctatcatgtccttcttacattcatcagcatctgatttcgcagacaatttgatgaaattctgataaatggagacgatggcaattactgacttggcactccattcggtagggattccggcaagctcccgctcatgaagaatttttgcatactgaaacagccgttttcgttcgttagttccccgcgggttgctctttatccatgcaaagagccgcatgaagaagatacttttcacttcctgcttggttatctccaggaattttgtgtacatctcctcaatctcaccggagaagagcatgatgataatccgttcctcattctcatcctgttctctgttcagagacctgcctaaaaaccagacaatattcgtgatatcaatgacttttccaaacagggtaaagggaatgtcccggttcagttctgctgcgatgtagaggagccgttcatcctcgttcggatacgtttcaatgtacttggagatggtgaccgccttattgtactgttcggtcgcctcaagccatctgagcaggtatccccggccgatatgccgctttgcatcctcccaggagaccgggtcaccgataaaggcatacatcaggtcatggaggctgtagtaattctcatcatgaaactcatatggctttgagatgcccatcctgccggtatgctcttcctcataatagaccgggatattccgtttccctgacagccagagcgaaacctcccgtttcccccacctcttcttgggattcctggtcaaaagtcctttgagcagaatgaggcgatcgggatttatctgctcagagagaataatgccccgcgaagccagcgttgagaggatgagattatgatttagtccgtcgaatggatgcttcttttcagtcagctcaagagcgatgacaccaagagcccagtaatccgactccctcccgaccacatttccaagctgctccggggcccagtacatgggggttcccttcgtcgtagtgatatgccgggacagttcgctgtcgagtaatgttgagataccaaaatcggtgaggataaggttaagtggtctgagctcacggatcagaatatttgatggttttaagtccaggtgcaggacattatttttatgcagggtgtcaaggccgaatgctatctcttcaatgatggccttaaaggtgttgttattgatggactgtttctggaccagatcgcgaagtgatccataccttgcatattccaggatctcataccaccgttctgaatcctcgtcaaaaccgtaatcgatgatcttgataagattcttcgggttccgtaatgagatatgactgacctgatccagcacgtcaatttttggttcaattccgagccggtaatgtttcaagatataatagacccgatctttttggataagccagatatcagcttccccaccggttgccggaaactgtttcatgatccggtatgttctgaaataccgctgggattcagacccggcgatatcaggttctgcctgatgggaaggttcaaactgtgctgacagcccgtcccgtaaagttctgcccctcttctccggactgtcaacatcttccggtatcatacatggctccggataccatgtatagggagtttatagaattaagatatatgctcatcagtcaggatgtcaaaccgggtaagctgctgaatgggcacttcatccggatttttctttaaacgctcaataaaaaggatatgttctttttttaattcatcctgcaggattgcataatcacgactccagaccgctgatgcatgtgcatcatccttctgaatctggtcagggtccagttcatcaatatcaagaccatcgacaatcctgaccagtctgaataccagttcatccagcggattgatggagatcatgatcgagtaatgagataccggagaaaagacctcaatactccccctccggaacgaatcacgtaggttagtcatcttccgtgacttgacccggtatccccgtcctttcatagcctcaagaatactctgaatgaccgttccccactgcttgtcagagagggatttgctctttttttgaaggtaatatgcatcatactgcctcctgataaccgacagttcacgaagctcagggaaggggtcatgatacaggatcatggcagcgtccaaaagggccccggcatcagggtccagagagagggtctggattatctcttcaaggtcctccctgataactgtcttctcagggatcttctcttttaaaagtccgtattccagttgcaggttctccctttgcagggcaagccgttcaggagttgtctcttttgcaaccggttcgtaatctgaactctccgtctcatcataatcaaagaacccaatgcgcccgtgaaaaaattccgcttccatggtcaggagttccaatgacacatcatgcgcaatcttcgcctttacctcctcactatcaggttcctcatggggaatccctccaagggtggtgtgttcaatgccagacacccggtggtcaagggctgaaagctgttcttcaagactcttcagtttctcttttcgggcctcgatatccgaaatttcagaaagggaagagatctggccctgtaatgaatgcaagatctccagatcctgaagagatacattcttcagttcaagagatgaggcctcttttttcagctcggcaatccggttattgagtgagagaagagtatatctacaggtataatacctggttgcaatatcagatatgagtgtcttatacgagtttatccgttcagactgaaccgcgacattggagagattctcaactgaccgtctgtattccaggtatgcagggttttcagcactgatgaaggattcagataccagtcggtcgaggaggttttctatcttctgtatatacacctcttccagaagtcgcatctcattttcttcaagaagaagctggatgagcacaattctgaaccggtcagctttccggaagaataactccatcgtctttctggaggattcaggagatttccaagccggataatctggggtcaggatttgctcagcaatttctgtgagttcttcatgcagtttaataacccgctcattcttgtttgtcagggtatcaaaccgtctttctgcactagataaaagagaatggattcgcttttttatccattcaattgactggcctgcaacgtcatcatcagaacgtgcaagagcaatttctacaacgatcagagaactcattatgacagactggttgagagaagaattgccgttacattatcctgtgactgacgtgccagggacgcgacgagcactttatcgaggaaggcataccccggatgtttctgaaggatcatctccagttcatcctgtgagaaacattcccaaatcccatcagagcagatgaagaactgatcctggtcacgaaggccgatggtcttgaaccagatatgaactgagtcctttatcccgtcaccggatatggatgaggtgacaatatttttccgtgggtgatacctcatctcatcctcagtgattactccctcttcaagaaggtgctggacgacggagtgatctttggttatccgttcgaagaatttcccgtttatccggtagacccggcagtctccaatgttgaatacatgggctttttcttcctggatgatgactccggcaagggtacagccgagatttgatgcttcaggatttttctcaacatacgcctccagctgttcttttgcagcatagacaaccgagttaaaactctcttcatcggttatctcggtaaagtgatcctgaaggtaggttaaaaccagctgggctgccacctctcctttctgttctccaccaatcccgtctgcaacacagaataaggcattcatgacctctccgctgtaagactcggggattttcatggagagatctgatatcagtgttcccggaatgaccagtccgtcttcgttattggatctgaccccgcctttgttggtgaaaaagaatgcttcaacccgttgtttcgttttattcataacctatatgaccatcgtgcttgaaagagatataccctactctgatctcctgcgtatcatataccggagaatgtgcaggttaaacgagcatacccacaaaccattaatataggagaaaggagcatgttttgtcggtgaggatatggtcatcaaggaaactgttatcaagcgtcttggggtgctgagtgtagcaaagttcagtgcagtcatcggagttatttatggatttctcatgggtattgttatggcccttgggatgggaagtgccatgggacttgccggggacgtcggtatgggagtcggtaccggtattgcggctcttattgtgatgatcatcatcggagcaatctttgggtttattggcggggcaatcgttgcttttgtctataatctggcccttggagtcattggcggtattgaagtcgatcttgagatagattaaccgattttttcttccggagccgttagatcacggtccctgtcactccggttcttggctttttttcttgcggtttgatatcggtcagatagaaacctataggtatggctcattcagtgtgtccggcagaacgtgcctggatgcttgacaatccactgagatcgcttctcataagaccgaaccggctgctcaggtcccatgtcagaccagggatgacggtccttgatgtcggatgtggtccggggttttttaccggtgtcatggccggacttgttggaccggaggggacggtcattgctgcagatcttcaacctgaaatgctggatctgacgaaggaaaagatgattcgaaaggggcttattgaccgggtgatcctgcataagacggcatcagaaacgcttcatctcaatgagtccggattcgttgactttgcaattggctttcacatggtccacgaagtcccctctccccgaacattgtttgcagaggtgtttgattgtctaaaaccgggcggtatctttctggtgagtgaaccgaaagggcatgtcaaaacggaggagttcagccaggagatgatggaggcacaggctgccgggtttctgattatgagagagcaacacagcctgtttgaacatcaggttctattgaaaaagccatgatcgaactattttgcgagatgaaaaatttcgttaagcaagcccttgatgagccgggatcccatgggtttgaccataccctccgggtggtatccctgtgtcacataatcggaaaagcggagcaggcagagatggatatcctgattcccgctgcgatatttcatgacattgcccggccactggagaagaaagggattccccatgaagtgaaaggggcagagatggctgaggagtacctgaccggaatatcatatggagaggagcggatctcccgaattgtccatgctatcaaagcccaccggttcagcactgctcctgttccggagacattggaggcaaagatcctctctgacgcagataaactggatgccatgggggccgtggggattgcccggacgtttatttcagccggggaacatggtggggatataagggacgggcttgatcatatgcatgagaaattgctccggttgtcggatgtgatctacacccggaccgggaaggagatggctgaacggaggcatagattcttagtggcatttgttcaggcactggaagacgagagggagatggagaaaagggtcgggttagattattaattccatcagaatatcgatgtcactcccaggatgttcctcaccccgggcatatgaaccaaagagacctatcctctttaccccatattttcttggaatatcgatgaaaagtaattcgtttcaattcagatttgggtaatatcggattatataatcgaaaattgtcgttgttcataatgctcaattcactcacaagagcatattcaattattttcccgtcgacctttgtatcatcccctgcaccgcttcgattcattcacgtagtgactactcacgaaaatcccccactcaatctccaggaatcgtgcaggggagagaacggaggataaaccatggaacaggaaacacagatacaacgagggatccggcttgccagggaagggaagatggaggaggcaagagccgtgttcagagatgtcatcgatgatgtaccggatgatgcatcggtatggtgtaactatgcaacgacctatctcaatgaagaagattatgtggcagcactcccgtatttcgagaaagcgatagagctggatccggcctttcatggtccgtacctctccgccgggatctgtcttactgctcttgggtttcatgaggatgcactccggttatatgaccgggcactgcaggttattccggataatcatgagatatggtataacaaggcctacacgctgatggaattggggagggttcctgaagcgattgccgggtttgatcatgtattgaaacttcatcccctggatgccggtgcgtatatcaatcggcgtgaactgctgaagtcatgtacgttcaaaggtcagtgtgttgtctatacctgtgaagaagggcagatgacccgggtgacggcgtatgtgtattcccatgaggggctgtgctttatgacgtttgtcgtggatgaggtggatgatgaggacctggtggagtatgatccggatgaggttgagatgtatgacgggccggatgatgatggggaggttgagggtatagagaaggatgatccccggtatgagaccaggagtcttgtgtactttacccctgacggggtgatggcccatggacagctcgagcattcaccggagtttccggcctatgcagagaattatgaggtgggtggatatgaggtcctttgtccggataatatctggtgtgaggttctgtgccggagtggacatcgatatctgctttgtcagagtattgatttcgtatatgcccatgacccggatactctggaggtcctggatgttttccggtttggggtgaaatgggatgatccggcgtatgaggatggctgggatgacggggatagggaggattgccagagggcctggaggtggtgggaggggagattgggatagtattcgtgatatgggttggattggattaaatcggcttatttttggaaaaatatttttcgttgtaattattgcttttgaatgtaactacaaagaaacggatccagaatggtcctccgatggattgtgcggatccggatccatttccggaaaaattgatgtggatctgaaaatgagtgaattatgcgattaattaaaaatgagcggaaaatcaaagatatcttcacccgtcggtctttggaaatttccggaaatttccggaaatgatccggaaatgatccggaagtgaatattgtgtacgtttactctctccagttcttagtaatactcccatttcaatcattttctttaaatcgtttctggcagttctatcggtacatgtaaataatgaagcgtattcggttgaattcagatgtgaattttcctccagaagataatggaatgctgctttctggcgattattcaataaagataataccgctgatatggatgaatcatcacttttcctgattatcaccctgaaatcaatgcctgaatcgataaattcgggttcttcaagtccatatttcaaacacgttgaaaccatggtggaagtacctgttccccattgctcaatcattttcgccaggtataataaccgagcgatatttttattttttggacgtgacaaatgttctcctttgagtgattcgacagtaactcctggaggcaatgtgcccggattccaaatttcaatccgatcatcaaaaatacggatttgtacgttagcagatgaactataatcacggtgacaaagggcattcgttaccgcttcgcgaagagcttcaagaggataatcccactcttcaacacgtttaaaagaatcaggtccgactgtgactttcctgttgatatgcttccggataaagttttcagaggctgttatctgttcaagaagtgttccctgaattggttcagccatgtcaaggaacccctgactcatatcacatcccttaaatcgtcctgctctgacctcactttgttgaataaaacgctgaggggtttcaccaaacagtaaaattgcggtattggtaggtcttccctgagagataagctgtaatcgctccaatgcattttcagaggaaattgtagtgtcaatcgctgttcttctcccctcctgtaaaacctgaagaaatctggaaacagatttgggatcaatatctgcgaaggtcgctcctgaacagggcagattatcccagtgatattcatcctcctgtctgatgatggtttgagttcatcaacaggcattctgatgctttccgttcctgaacgaacatatggctgtccgtcagcgaaatacggcttattagttccttcaggtactgtcactataagaaatgattttccatgatatgattctgaagtaagggataacgatatttctggttttattctggcacgaattttttggttaacttttctaaatgtggtatctgtgatagtaagaccagcgatttcaccattcggtctgactccgaagtatactgctcccccacggtggttgagtaaggcacaaatgtctatgattgcatcttcgagttcagataacccggtttttagttcaatggtttctgactcttctaaattactactacattggggtgatgtcataggggtcagatatgattggtatggatcattcctcgaagcagactggcaatatgggcttctgatatccaatgctccatattgctgatatgttcaaacgattcaatatactctgggagtgatagaatatatgttcttttatacccgtacagcgatctcatacctgagccataggacttttagtattagcattatgatccaaaataccctgcaatctgtctgatttattcgtgatttgtatgggattgaattagctacatttatcttaagatatttttatcaaaggggaaatcatcacttatatacacaaatctcacagggaggagatatgatcgcgattgaagaggttgaatctacccttcggagactaccggaacctgcccagaggtagatcatttcatatattgaagcaattgtgaccgctgaagaagagatgaaggaaaaacctccatgccggttctcctgggttggggctttggagaatgaagatgtcgggagtagttcggtagatattcagcataaaacagttatcgcactggattattttaatgggcgaataaaataaatcgtgaaccctctcttacttgttccatccaccatccggcagcctcattctttcagggaggacttactcactttatctcattatcataataagaatgaaggattgtcggtaccctggcagttaccaatgatacagatcgatatggaaaaccaaggtgatatcgatagttcccgataggtaatgagatattgattgttattccggtgacactctcttggattcgggctattttgtgatttaatttttggtatcggtacgcatttaccggaatacaaggtttcgagagaaatggggtatctctacacccttcctctatacaccgtgatctctgccttctctccgccttctgcaaacagggccgggaagactctctcatccccgttccgttcacaaaaccgtcggagattgaacatatgattcagcccggccattgcatacttatttttcaggagttcatatgactgatccaggagtggccgtgagatgaagaggatacatttcgtcttcgccctggtcacggttacattcaaccggtttaacgagtagatgaagttcgcttctgacattgcggtttcgatatccgacactccgtaacttgcgatcactgcctgactctcctggccctgcatcttatccacggtatcaacaaagggtggatgatgccaggtcattgatttattcaggagttttctgataagccggatctgtgcatgatggggacagacgataaaaagcccgcttccccagaactgtttatgcccttttaacgtatccgggaaggtctcattggttttgtgattaatcatgcactttttcaaataacaggcgagtcgtgcggtgaggtctgcctcgaccatgttatccaccgttgcacggacattatcaacgatgcagaggacgaggggatagtccgggtccagggcccatttcaggaattctgatccctcatcatccgctgcgtcacatgggtcggtgatgagtaacttcctccctgcaatcttcgcggttgccgggatgtatccatttccatagagggtttcagccgggaagcgggagagggttgtgttcatccggaagttttcgaggagctggcaggtatagacattcccgctatcccggtaccggagataggagaagacggagtcatacaggccggggagtccgtcatccggctcggggtactcaccctgaatcaacgggggtaactgcatatcgtcaccggcaagaaccagcctgccatcggttttgaggataccgatgaccagtgagaactcaccgaacttcatctgacttgtctcatcgacgaccagcatgtcaaactgtccaaggttggtctcatatttcttgatggcatataccgtacctccaaggatgaggtatggctcggtggagcttgatgctgcaagtccctgactgtcgatgagatcaaacccgtcctgactctgttcagtcagccggtccagtttcccaaggagtacgtcatcgctgaggccggcatcggtgaggttgtcgcgtatttcccagagcaggttttcaatcgcggtgtgggtgaatgcggtgaccaggatccggaatcgtttcccggcacttttgtatgcctgaaggagagcaacgacggactttgcgaggaaatgggtcttgccggtcccaggcggtccccagatgagggtcattctccgggtgaggacggtgtcgaacgccttctccttacttggcatgaaatccgctgatctgatatattcgagggcttttgatgtgatcttcgcatcgggggatagaggggatgagaacccggccgggtccctgaggagctggagaaagagtgaatcctccttttgatctatctcgatgagttgtttgaagatcttatcggagttgtaatccatgaaccggggatggaggattgctttctccccatcttcaaagggcgtatggcaggatttatacgcgatgttcatgattatctcacggatatttccctcatcatcgacggtaaagggggatacgtcgcttgctgacatgagtgccggcagatggtttgggagataggggcgattccggctttggtaatcgttcatcttcatctgttgaatattcccttcttcactggtatcggtgaggattgcccggaaggaataactgttgctctcgaataatccttcatcaaggggggagtccagttcaaagacatgtgctccgtccatcgtctcataccggtaggtgagcgggattgcactcccatgctcgatccgttcactcatggggaggcaccgttcttccctgatggccatggctcccatgaatgattcatacctgacgatgaacccgatctgtgagagttctgtgttgcggaagtttgcctgtgacgggaaactgaatcgctgtggataggcaaagagccggtctttcacctggtcccggatccctcccaggatggaacccgttccggtcagtctccggttcacttcgttgcggatggcgtctctatccttctcatccccggtcttccagtatttgaagaggggatcgctcttcatgatgttgctgaggttgaaccagaagaatttacttggagtgatttgaaagtcaaatccgggtgaggggagatttttgaggatgtccgggagtctgtaggtgatatggaccggtactgccaggagttcgcggatgacctttgagaggacaattatcgggtataccacctcgttggccggttgtttatctgcggtggataatacggtctcctggaaatggaagaggaggtgtaatgccagtggtgcgaggtcagggactttcaggctgtcgaagaggagccggttaaagagggtgagttcaaatccgtcaaagacatacacctgcacactgacctgcctggcccactcttttccgtaattgtaatccgctacctgtttcagggtagagaatacattctgaaggaactctgtctgtgcatggaggcagtcgtctgcgttcctggcgatactgacgaaggttccgacattgtttcccaggacctctttatcatatgccgtccaccggtatcccagcacggccagccttcccgacaccgggtcctcctgtaaggtgaggaagaaccggatcccctcactgaccgggagagcgatggtcgatcccccatgggatacgagtgctccttcttcaagtgacttgacggtatgcatgagccgctttcggttattgcgaagggagccacagctgtttaagatgtcttccgatgcggggtctttcaggaactcccggagttcggggatggtgttgatgggttctccgccccattcagcctccctgaggtacatcctggccggggtggagaggtacgggatgagggagacggagtgtgtccgttctgcttcttcccggcagttttcgtagaactcacaccattcacaccggaagttgaggtgccagaagacggattcgatgtcatcggtgaagattgtttcaaggttaaaccggagaaattcacggacgatgctgagcgagtgggataattcaaagatctccggtgcatcggtgttgtagagccagacaaatccccgggtgagatcgacggtgaaggggaggtgctccttttctgcgatggcctcaaggatgagggcatagagggcgatctggatctggtggctctgtttcaatgcatcgctggcctttacgtcaatgacctggagggtgggttttccgtctatctctgccatgaagaggagatcgggcctgcatggggggaatgcgaacttctctgtatcgatgccaagttctttgatgagtgactgtggcatgacgatggtcggctggtagagatactctcccggtttcatcgttttgagaattgacagggtttcatcgagggtatgggtccgtttatggagtggtccgtcccggtctgcgatgtggatcttcccggtgatccggtttgtgatgacctcttcttcccattcaaatcctgactggagtatggcggcaagggcaaggctttgctggaatttggattcggggatgtgtatccgtgttcgttcttcgactggtgaggcgttgtaccggagatggcgatcacagccgaagtagtagtatcgggcgatgagtgatggggataaattatacttagtcatttgggataggagataatcggagggggtgagggatatatgttattattttattattcggttggtcttgaaggggggagggaatgggatggaacggtcttattgagtgtcctggattgtgggagaatggggtgatggatgaaggtcagtccatatagaagtaaatttcagccctaatttaattattcatattaataaccgttccaaatcgtaataggtttgaaatttttaaatccatttcgttaaataaatcaggattgcctcgtgctactcgagatattgaatggccaattattactaaaactcgagttgcttctttaccaatttgatttatttcttcataattatcaataatctcctgatgccctaataattgaccaataactttcaagtcttctggatttcgaaaataataatgcatataatctttagagtagttgaataaccccttaaaagtttcttttactaaggaaaaacccattagtcgtgcaatttcccataacttttcttgacttaaacctatttgcccatgattaaaaatattattaagatcttgaggattgattaaatctctccaaataaaagaatctgattgtgagtaatcaaggagaatatcttcacctgtcaaatcgtaattcgttagtaaatatgccaaactaaataatacataccgttcatcctcatttagccaatgtaaccgccccatattcgacttattatataaatattcaggatctgattcagtgtcaacaggaatatttgatattacagtataaaaggtgcttaatgctgttaagggctctaaaattctctccaaggaagaatccctttcggaaaaaaaatcatttaacaggtaattatcaacagtttctttttcttccgttccaatataaaatatttggtctcctggaatgagatcttcgataggaactaaatccaattcatcattcaatcccttttttctaatgagggttctttctttaaagtagattttttctattactccatttgagaattcaacatttatggatattttattaatttcctgattgtgtccggatgaattattatgaatatatgtagattttgtaggttggactggttttttctccaattctttccaaatattgctcaatgttttaaaatcttcattttgagtgtcagaatctgaactcaatttgccatattcggctttgatggcgctatttaatggagatatttccacatcagaaatattgtcgctaatatctgactcaatggctggaattggtatcctattaacgaatttgttgtatgtgattgatcgtttcaaatcagaattactaattggtgaattcgatgatgacaacaaatcattgcatactttgatctgtgttaatagtaaatgcccattgaaaccagggtaacagaaaaaaagaatctttttaaaaggaagtaaaaatatatcgaagtattcacctagaacaagttgatcgccctccatcttaaaaaacggtaagggtccagggaaaagaatatttttagtctttgccttttttggaggtagttttgaaagattttctagcgattgtatttcaaatttataggttaatgtcttgatcttcttttggttatttccaacgagaattatttccactttggtatcattttgtgttccaaaattcgtattgatcttatgaacactatttatctccattacaccatctttgtaaaatacaagtcgtaatagttcaatctttattacggatacatcattgaaacattcaaatccaagggatccagaaatacaattaaatccactgttaattggaagaaatatttttaaatagacattaccatcttcaatattcaaatctgattgtaagaaaaagggagaatatctatttagtaggtcatttattgtattggatgattttaaattaatttttttattttttgctaacagaacgggattttcattaattgttaaccatacttcttcttcgttttcttctatactaatattatgaataaaaaagacaatggtttctaatgcctcgaataacactcgaattgtatttgcaatcgccttattggttccacatttagaattaaaattagaaagaataaattcctctgtgtttgattctctgaaatttcctctagaaatatcaaaatactccttaatgtccgtagatattaaatttaatagaaatgattggagtagagtttttttccttattgatttgcacgttgggagattgagtaattcattttttatatcacgggctttatcaagatcatagataatatcaaaaaatgattgaatgattgatgaattttgatttggtaatgattcaattactaaattcaatggtaaaaacctataattattagatgtatgagaaaatagtaatgtttcacttggagatagaaaagaatcaataatcggggggaatttaataatatttcttaaatatgaagttttagcaataagatcttcagaaaaatttcttctgataattcttagggaatcataaaattgcattgtgccattgtgtaaataatccaattgattctctaatttccgaggataagtgttattagggaaaattatcgataaattttttaagagattatttgatggataatatacatcatcccataattctccttcaaatgataaattgacacagtcattacggggtttttgaatttgattagatattttcttacaaaatacttttccaaaatgatatactgcaatatctaattcagaaaattcagatatcttattaagaaaactttgaagtttcggaacatatggccatgaaaaatgtaaaactaattttatattttggtttttcgtttgttctattaaatagaataatgcgtcagggtcaaaaggtcgttcattaattgattcaataattatgagtcctggtgacaatttttcaatattataagcgctttgttcaaatgtaatattcgaattatttataattccagctggaatggaataaaaagatggaataactgcaatttttctagatgtatcttttctactttttagtttattttcaaggtattgcttatattcatttttaaaattatttttaccatgaaccggcgaagtttcaattataaattccttaatattactaccttcaacatctaactcacctttacaaaaaaggatatcttgttcaaataagaagaaagggtgtgtttcaatattgttgttgatatattttgtaaatagaagcgaaaaaaatattttttgataatttttatattgatcttggaaggataatggagggattaaaactattacatcttttttttcatttattgcatataatatagagactaatggagtaatatttaatggaccttgacctacaatgatgtttatttgtttttgtaaaatagattcgattatatcaagagatgtgtcagatagttggtcattccttccagataataccttgatttgatccctaccctgtgtgatgtaatgcaaagatgcaatattttctggagatagattgaaaaatgccatatatttaccttatatatccctgatatgatggccactttgttccttctttcctacctcttaatgttgctcggtccaagttgtgattaaatctttcgcatacaaattcgggaaggtatgaacatgctatacaggcacctccttcatcgtacaaacatcctggatcttgagggcaatcatatgcaaattcgaacactttcgaaaaccaatcggagagataattgtcgtaggtaaattccaatccaccaatatttatcgcatttgtagaatagataaaaaatgagccttgtattggatatattatctcagaaagactttgattgtcaagtccggtaaaaatggatgactgttgaataagtaaatgacaatatgtgtgtagtagtgtctcgatgtggattcttacatgggggtcttctcgaacaagttttctataagtgatttcatctttgtttcgaatattcgaaagattaatattcgcttttatggtactttggttatctaaaatccaattaatgagtttttcatgatctaattggaacaaaattccctctgtttgatattgtcttacatatactgtcggggttttccgttttccttcatagataggagaaaatataataggatctcgacgagttgatcctgcaacattcccaagcatagcttggacaagattaatatttgatatatgtcgaattccgattaaaccttggcttttaatccaatcgtcataattttcattaaaagataatggagcatttcgaataactggagatgatgaacccggaattctcgtaggtgaagagctatttaagaaatctccctgcaaatctttttcactataatcgattgcttttactgtctctaatacgtcttggatctggtataatccaaacctagttttaattttatccggatttggactttctttaatatgattatacccaacctttaaaagagttttaattatttttaaaaattgttcttgagaccaagataggtaattggtacaatcaaggccaagcatttcagataattcatcaattttatcaagagcccaaaattgagtattattctctaatgaacttctaaattcaggcaaatataataccgattcatcatatgagggtccaaaaatttcattaattgcttcagctaatacccttgcatcggtatttcttctaccattacggtctaattctccttcttgcggaatatccggaatgacaataatatagggatgcaagacggctccagcttttgctgaagtaattcgatattttcgaggagggtttaaactaagtggtatatcatcagattggaattttttatgattacaaaagtagatgatcaggttttctacatgcccacatttgtggcattttatagaatatgtggcaaaatcatttctatctcgccaatttaaaattgataatccattttcctcattacaaccaggacaattagagagtaaattcgatgcacgatgcaatggaacaaataatccgcattcatcacaaactgcgataaaagtaacttgtcttggttttttagatgaatcgtgaccgcattttttccctttacttatgacaaaataatgattacatactggacacatagcagcattgggaaaaacggtaaaaatgcctgattttccttcagaatttttatcgtcaataaattttaaggatttaaaattgaggtcaaagggttgaaggagcggtaatgtaccgcccgctccctgatttcgccttgaaataagtgtgttaatggtttttacaaatgttcttcgaaacttttcaatatttattccattcagagcttcatcgtcgttccataatctctcgataagataacttcgtattccttttgaaaagaattgttctgggtttccttgaaaaaatgcactattttcctgaatttggtgggtaataattggaatcatgattattgaatttggttaatgtattgctcatcgtcaggcttcaattgcaaaatcaattgtttttgaatacctctcataccggtttgatttcgataatacgaatcgccgctattatgtgagagaatattagggaaaaaggtattatctgaaaaaacagtatcttcaacgataaaactgattctctctttgacttccctctcgatgtcaatttcattttgtcctccataaatctcttgaatcccattaataatttctttaatctctacttcttttaaggatttaatatgtttttttctgtaaagtggttctcctcgaatgttcgagatgtgattgattattagagcacaaaaaattgaattcaaggtttggtaatatcctagtcgggcagaacgagttattgggaccggtttgacctggtggtccaaggtatcatgatatcgataaaaattccgatagaaactatcatctctcactcgagttggataaaaccaaacaattattagacccaattttttcctaccaactcgggatagggcctggatgtattcagaggtcgaataggggatcccttgaaataccatgaaattgagttcctcaagatccactccatgagatatcacagaagtagcatataggggatcaatagttaaagtttcagaaagaactttttcaggattgtaatttttaatataatcacgaacctcattcattgcgacttttaattcttcgagtttagagtctccagttaaaactttacctatgactgaacccgggtacctttgcgaaagctcaccattgatgatataatctctaaatcgagacatatcttgaacatcctgcttttttaaatgataggttactggaacaataaattgggtaatgatatcttgagcttcttgaggtgtcttacatccatatttttttgtgaattcatctgggtttttaagaagagtcaattgtgcctcaatgataaattcagcataatataatagagtacgaagggttgcagtgtggttatcctgcatatttggctttaatccacaaataatacgttttggtccatttaatttttcaaagaagaagtctttacttgatcctattccttctggagaagttcctgggataataatcgtgtttttattgtataattcatgaatttgagttttagtgccgtttaatgtagcactcattgcaatatgcttaattttatggttggaagtcttattcacaatatattcaataagactttcaaaatgagatgaaatggtcccaaacccttcttttaataaatgcatctcatcttgtatcgataaaattggcccgtcatgaccctcctcatctcccccaatttttttacacgaataggcttcctctttattgtcttcgcagtaatctcctgaaggtatgaatccatgtttatatgggcattgtgatccagatcccccaagcaaatttcttgcccttctttgtgatgataaacctgcccacttatccactgtagatacaatgaccgatggacgccatctgaatatttctctgtctgaataataaatgaaaaattcacgattacatgaattacatcgatggactattcttttatgaatttcatcatcatgtaaagatacaattccttcttctttctccctacaaaaaggacattttggaaggatgagagaagatggagcaggttcaatgacttttcccctatgatacaattgagatctaatttcagcatatttagaaggaaactcttctgaattaccaatgtaatagcctaatgaaaaaggttctccttgagggagcaaattattctttcggatatcgtcagcgttaactacaattgtcgcaagacgttctaattgttgaattgatagcatcctcaaaggaaatttgacgattgaatgtactcctctattatatcctttcatcctattgtaaaatagtgcgaaggttattacagcaaaatatgcttcggattttcctcccccagtatccacatgaagtacatgaaccgtatctaaattctctcgttttactattgaactcaacaaagagatgatgaaaacaatctgaaatagacgccattcaccattgggattgttttgttgtaggtatgtctggtaaaaggtttcattcattaaattgaaggcagataaaacgtcctgattgttttccaataaatttatcccattactcagttcctttaacacctgtttaaattgaataatttggtctcttttttcagatactgaacgttgtctcttcccctctcttatgagaaatcccttctgtggtagcgtatttagttcttcgtcaaaatccgtttctagtttcctgaatgctataagtaacttgtgcaattctgttattgattcagttttacttcttaacttgttaaaactgagaatactattttccaatgaattttttggtcgaatatttggttgctcaaatagtccataatgagtagttttaaatgaaatacctggttctctccattcaacctgacagtttattggacgaaatgaatagaaatacttttgattattcccttcatattcatattcatcagaaaattccaaaacgtgaatattttccagagaaacattcataacaaaattgaataatgttctttcatagggttgttggggaattggatcaatactattatttaatgcctcgatggaaataagagaagaagtatcatcatatgatgattgatatacctcaattgaagcattccataaatcaagtggtatctttttttcacataagggatctgaattaattttctcgactacagtatcaaatggtatacaatattttccctttaacggatattcaagagtaaattcaaaagaaaatgattcccttttccaatttcgtccgattaattcattatcagaagatttaggtttatctattacttcctcattcgtcgaagaaggcgatcttaaataatagacatatccatttccattgatcttaattgaagatttttttgataaactagatgtttctactgggaagacgattttatgcatctgggcacgtatgatgttttctttctcaattttgacctcatcaatgtcttctatttgaggttttttgggtgctagtgagccaataaaaaaacgattactaggcctaacgttaatttctgtgtctaaatcatgtgaacctgagcaacgagcgatgatatattgtagcagatcgcttacaaaggctttttgagaatcaattgtcgtcatttttctctctaattttttattaaacggataaaaaggttatttactcttattcatgattaataagaaatcctcttccgggatctcacgcattgctactcgcaaatgaccggaccacattgttttattcgtgataaacttgaggtcattaataagaggtttgaattcaacaggttctttaaaaatattcaccggtttcagttgaaatcgatatggaaagatttcatcacccatctgtggaggggggatgaagagcctactctgatcttcaaaacatttctccacttggaatgcccctgtgattgcagaggggagaagtgtatttccatgctgttctgcccgaacgtaaataaggattttatctcctggtgctacccgagttagaagacttttatttcgcttcggcacaccccaaatatcattattccgaatgatttcccaatttggtcggttcgatgaagcgatccaataggacatatactatccttacactttgttcattaaatgattatcgaaatacgtttacaataatagtactattaaactattgagtaattggtactggcctcctttagaactgaacatggtagtttaaaaactcactccaattccaaagatgatcagtaatactttctaacattgctggagacttgtgactactttttacttcgataaaattatgcacaaattgaaagatatttagcgctgaaatgaatctattgagtttttttgaaaaagaggcagttttccttccaaaacggctcaatcgttgtctgattttattattgtagccctcaatgactgaggtagagattgctttactatctggatttcccataattttctctcgaatgacataaacaagtttattcttctcttttactttgatcacctgaccataatccaagcatggctcacaatataattcaggtaaacaaatgctatattggacgtttccatcagtaaaaatcgatattttgttttctggcgttggaagttccattcggttaaaaaatcgaactaacatatctgcacaagtatcaatatttctttttccagattcaaatgctaaaaataatccagaatcccttttaaaacaagtataggaccaacaatcacctaattcttcagagtcagttgttaggagattcttgtttttttttgaacaaactcccaaatttcatccatctcacaatcccccgcggaaatgtcatgaataaaataatcgttgagtttttcagcatgttcaccgattaagtgataatatcgagatatagtgtcgcgatggtgtccggtaactcgagatactcctcgaattgaagttttttcagtcgagtgtttcgcaattatgagaacagcagttcgtggtaaacgagaatcatacagaggagtatttttagtttcaataaaaaaacgtcgacagtgatggcaatagtactgttgattgcctgcagaattatgcccatttttagtaatattctttccatcttcaatttgaaaataagtacaatccggattttgacacgtaatcaatataggaccacgttttccaaccatgaaaataattatatctaaacttatattaatttttagtacataaaatttaatactttatttgcacttagtattaccagcttgctaacagggcactaccgagtaattagcaatgatttaattaagaaaaccgattatatcctgaattccttctttttggccattcttctttatcatatacaggttttataaaaaccgtaacaattcaggttttagaaagtaatcaaaaatagagaaatctacttctataggattattcccccataatatatttgtttgtcatcttttttctgataaaaaatcaagggaatttagtaagtattaaataccatagatatctaatagatatctaatgagaactgttccattcaatgttgctacagaactgaaggtaaacaacatttgtggattttataaacgagaagtcaaaccctttggaacaagtgcgaaagtagattgtcccaaggaacatttgggtaaaacggtttatttggttattctggataatgacgaataataggacttccgaaatcagtgatgaatctatagacgatttacggcgtaatatccatcaattaaagaaagaacttaaaattgaacgtaaacgcagaattttagcagaaaaccaaaaaaatgaactgaaaaaggaaaataaaaaactcaaaaaagaaattgcaaaaatattgagttctgcaccttttctttcagcatcaagtaaaacagctaaagcaggaggagttccgagttcaaagaccttttatcgccggaagaggcagtgtgaagaaaataggaaaagtggaggtcaaccagggcatgaaggaaatggaaggaaaagacccgcttcaaattcaccatcgatgaatatccccttggattcatgtcctgaatgtggaacgcatttgaatgaaccagtcaacggggcggaacaaacacgcaccattacggatattccatttccaaggcacatcgtttacgaaatccattatccgaggtattggtgttcaacttgcaagaaattagtacgtggagagttgcccttaccgccaaaccagcaattcggacctgctgtagcctcttggattgcttatcatagaatgttaggattgactataaggaaaatccaatccagcctcttagaaacatacgatattcaaatgagtgaagctaccattctgaaactggaaaggtgggttgcagatactctcaaagaagattacgaaaaactcaaagaaaagataattcaggagaacaatatcaatgcagatgaaaccagtttcagagtgaatggagaaaatggatggttgtgggtattcacttcgacaattggctcatattacaaagtggcatcaactcgaggacattcggttcccgaagaagttttaaaaggatttaatggcgttttaggaagagatgcatggaaaccatatgatgtcataatgtgttcagggcatcagttagatcttcttcatgtgaatcgatggttggaaagagcagaaataaagcacaaaattgaaccgcgaagtttattgacctctcaaccagtcaaaatactaagaaaaggcagacctccagaaaaatttcttgaatttgttgatggagttcgttcgattctaaaaaaagcggtagaatatactgaaaatgatcctccaccatctttggatgaacggaaaaatgcacgtgataaatttcaggctgagcttacgggcttgcttgaacgaaaatgggtagatccagatgttattcgtattttcaaagaacttcgaaaacggcaagatatgttacttactttcatggtccatgaggatgttccagggcataataatgatgcggaacgtgccatacgtcagggggtacttcatcgaaaaattagtggggggagaagaacatggctcggagctgaagtatttggagtcttgcttagtatttacgaaacttcgaagaaacaaaaggagaatttcatgcaattggtgggaagaaagttaggatttgaagcacctgtcgagaatggcaattgttcaacttcctaaagttgagtagttacattttatcttgaggactcattcaataaaaaagtggatcttgtcattgaagatagcataaaaacccggttaaaagatagaatcatgcgggaaacagtatttgcatgaaagactggattctttttgtggaagatatttttcatgcatgcgttgatatcgaatcctatgtaaaggatctcacgtatgaatcatttcttgatgataaacggacacgggatgcaacagtcataatttactcattatcggtgagtcagtcaaacatatcccttctgatattctagactcatatccggatatagaatggcgaaagatcgctggtttaagggatattattgctcattcatattttaatataaaaccttcaatcctctggaatattatcgtaagcaaaattcatcccttgaaaaatgttgttgagtccattcttactgaacaagcagaagaggcatgaatactggcgggtgagtattggcgtctttacgttctgatggaactcataaatattacaatctcatgtattaatgaggctttggtgagaggtattaatcatatctcttccgacgatacctcaccctgttctgctaccgtcaccgaaccaaaaacccgggggtttccagcactcatgcagcatggagataatccggtccggagcaggtcccttcccttcagcccctgcggtcgccatctcaatgacttgtaatgagccgtcccttcaagaataattgattatctatcgtcgggatccggagcacacactgaaatctaaacctgagcggacaggactcataggtgggaaaatacgaaaatcggtaacgaagcgatactatgggaagacctattatgatatagattataactatttctcacataggtaatcgtatgcttcatgcagtcagacagcgagtgacaatcgggcaggatggaactatttcacttcatgttcctgatttaaaaccgggatctcttgctgatgtaattattttggaggcccctgatcagaaaccaaaaaaaggacttacatcgtttattgggaaagggaaggggtgttataaatctgtcgatgaagtggatgattttattcgaaatgagcgaattttatgggattgagcaacactatttctggatcccggatttatctggacaccaatatttttatttacgcaatagaaggctacccggaataccagtcaatactcacctcactttttcgtctttttgatgagggtacatacagtgcggtaacaagtgaactaaccctcgcagaagttctcataaaaccaatgaaagaaaataaaaaagaaattcaacagttatatgaagaactatgaagaccatcagatgttctcactatctgcactattgatcgacagatccttattgatgctgcaaagattcgggcatcatcggatactatccttttgcctgatgcaattcatcttgcttctgcccgaaaccaaaattgttcttcttttattaccaacgataaacggttacggaagattgattcttttcaggtagttattttatctgaactatgaaagaagcaactcatcgaattctatgaaaaaccggttcattttagggagtgaatcctcaatgagaatggtatccggcttttcaccgttcatatctttcactccggaatatccgcccggaatggaaacgacagttcatttccgaaaattctgtactagttcttcaccttccacatcgggtgttccgaaatattgcttcgactgaacccttactctgttctgctaccgtcaccgaatcaaaaacccgggggtttccagcactcatgtagcatgggaataagccggtccggagcagatcccttcccttcagcccctgcggtcgccatctcaatgccttgtgttgagccgttcccttcaagaataattgattatctatcgtcgggatccggagcacacactgaaatctggtttacactgactgatctcattggtggtaagagaactgagggaaaaccctcatgaaattatgatcggggatcacctgtaaatatcccgattaattgcctggagaaaaatggaaaggagaagagtaatcagttatacggatggaatatggagggttgttttcagtttctcgatatccgatttatcaaaaccggtagcttttatcacgaactcagtatccatacccagagaaagtaggtttttagcaacagtttctctctcctgttccctcccttcttccattccttcctctttttgcttcctgcattcttgtcacctgatcaggaaaaaacatctctcttgcttcatagcctggattcccgaggagacataacgataaatcctcatattttctaggagttacgcagaacaacctctaaaaaaatttatagcgcatattttgggttctgaatatattctgaaattccaacttttatgatttgccattgagcatcgtacggagtaacactattcaaaaatttattgacttcgaatcgtaaatatgcccgaagtgagcaattaatatgatttcgttggataattccctttctagcttggcattttttgacaccacatagttctttgatagccctatgataattctcgattgtccagcaaatagattgtaaaaccagcctatcttcattattcatcggcaaaaaattggttgcccaatatctacttacacctttacgatttagtgagtgaaaaagacgaataaatccatatttctttaaatggacttctaatccctcctctggtatatttaatgatgacacttgaacattaccttgggcatcgggattgaccatacgatttttcttaactcgtgtgaaataaaaccatccaagacggttaatcaacttcaaattttcatttccggaataccaactatcaaacatgacaaaggcaggagtaaatcctctcttgaaagctgtcaaggccatttcttggagatgatcatttttggtcttatcatcaacatccttatcataaattcgataatcaattggaaatgaagtgattccatctgtccaaattaaggtaatcaatcctattcctttgattactttgtgctcttttccactccactggtaatatgtacattcgatttttttggaatgttttttatctagaatagtgtcatccagaaccaaccagcccctttttctgtcaacatatgcctcaacttcagcccacaacgtctcaggagttagagactgtcttgttaggaatcgattgaaggtatcatgtgatttcgagaattcagacgtcgaataacaatcagtgacttttatacaagaaacgtcgcatcgagctgcgatgaggtaattgatataatctacatctgaaggctgcttcgttataggcacgtatattataggcgtcgtcaatatatatagatctttctataataaaatttaactgcgtaactcctattttctttgaattctagaattttctttaaattatctagcgacacctttatctcgttatgcgtttaatgccatacataacgaggccaagatcagcatggcgacaattgtataccaaacggataagcgatccgggatcacgtacgcatatcaatcgatatcattctgggacaaggaaaagaaacagtcacgtgcccgacgtaccttaataggaagatacgataatgaaacaggaaaaatcgttccaacagacggaagaaacaagaaaaaggcaaaagaaaaggaagccgaaacacgcggtaaaacagttatcaatagcgcacatcgttctttttatggagcaacatatctgctggatgcaattggtgaaaaattggggattacacaagacctcaaacagtgtttccctgacgaatataagcagatcttgtctcttgcatattatttgatactcgaagatagcaccccattatatcgctttgagaaatggggatcgctccacaaacatccgtatggcaataatattacttcgcagcgcagcagtgagcttttcgccagcattaatgaagaaagtaaacagcgtttttttactcttcaaggaaaaagaagaatagagcaggaattctgggcgtatgacaccacgaccttatcaagttactctgatatcctaagacaagtacaatatggacataataaagagcacgataagctccctcaattgaagttagctcttgttttcgggaaagattctaacctacctttctactaccgaaaactagcgggtaatatcccagactcaaaaacaatccggcgatttctggaggaactggatattctcggttattcgaaggttaaactgatcatggatagaggtttttttagtgaatataacatcaattccctattccagaaccatattaagttccttatgtctgctaagatgtcgttgaattttattcagaacgaattggatgaggtttacgatacctttcgcgatttcgaacattataatgagaattatgccatttattatcgaaccgttcgaactaattggaattacacgcaaaatcgcccttataaaggagataaactcaaggaatcgcgtcgaatatacattcatttttattataatatcgatcaggcagctgatgacgaaaaagactttgatcgtagattaatcgcattaaaacaggaattagaatcaggtgaacgcattccacaacatgaaaagttataccagcaatatttcacgtataagacaacaccaaagagaggaacccatgtcacggttattgaagagaatgttaacgctgcaaaaagaaattatggcttctttgccttaatcactaatgaaaagatggatgctattactgcccttgaactttaccgcaataaagatgttgttgagaaggcctttggtaatctcaaggaacgcttgaatatgcgtcgaaatctggtttcttcagagcagagtcttgacgggaagttgtttatccagttcgtcgccctgatctatctttcttatatcaaaaaacagatgcaggagaaagcgctttttaaatcctacacaatcccgggtctattggataaattggatgtaatcgaatgtttcgaacagccaggtagatcacttaaagtgggagagatcgttgaaaagcaagaacagttgtattatgatctaggggtggcaccgcctgcctcgttatgagtcgacgggaatgtaggttcatagagtcgccgggtctcttcatcaagactcatcatctgaagagaatggagtgtcttttgaacagcgggtttgccttcagttaccatacttatctcctcctccgcatgtgcatttaaaaatataaaccacgatagagggtgttgcacaactcagatccccccataattttttaactaaggtcaatcaaaagtactttaccttagtacgtccaacatatactcaatgtataatacgataggtcgggattttgaacaactttaccttctccctgaggatattagagactgggttccgagtgatgatttctgtcatatattagagggtgttgcacaactcagatccccccataattttttaactaaggtcaatcaaaagtactttaccttagtacgtccaacatatactcaatgtataatacgataggtcgggattttgaacaactttaccttctccctgaggatattagagactgggttccgagtgatgatttctgtcatatattaattgatttaatctcaattctcgacctatccccattatataaggaataccgggaagacggccaaggtgcggcattttatcatccagaaataatgactggtttgatcatttactcatattttaatggagttcgttcaagccgtcaaatagagaataaatgcagatacgatgtaggatttagaatagtaacccgcaattctctcccagaccattccacaatctcgcgatttatcaagaaaaacagttcttttattggacaacttttcattccagtattgactctccttaatgaagcaggattaatcaataacgtccttctcgccttggatggaacaaaactaaaggcgaatgcttcacttggatcgaacatgccatatgaaaagattgagggagaaattcaaaaatatctaaaggaagtccaagaaaaagatgatgtcgaggatcgtctttatggcccggataaatcaggtaacgaggttcccgatgattttaagactcactcaaaaaggataaaacgattcattcaagcaaaagaacgacttgaggctgaacataaggagaaatcccaaaaaaaggaagagaagattgcccaaagggaggaagaggagagagagtctggaaaaaggaaacgaggtagaaaacctaaaaagcctgcaaaaaaccctgatgaacaaagtcttgcaaacactacagatcctgatagttcaataatgaaaagtgggcctggttgtattcaaggatataatggccagataattgtaaaccaggatggctatattctggttccgtttttaagtaattcacccgttgattacagattacttcaaccatgttatgaaagattagaggaaattgctcaattaaccggcttatcgcttgaatatcttaatttacttactgatgctggttattggagctatgaaaactatctgtatatgaaacagcaggatattggatttctctgttctacatgccatgaaccagatattttcagtattagaggcctcgagagaagtttacttgaacttgaacgaatttccgatcaactttttgatggcatttgcagtattccaacgttagcatctattggtgattggtgtacgagaaatctcattcaagatgataatattccaacacccgcttctattgctaaagggattatggaagtgacaatgactccgtatggtgccaaaaagacatattcacaacgaaaaacgattgttgaacccgcatttggatggattaaagaaaatcgcaatttaagaaaattgcagagaaggggaatatcacattgtcaggatgaatggagtttgatttgtttaacacagaatcttcggaaggtctgttcaagaggggagttgaagaaattcagagaactgatcctgcaaaagaagcggcatattatctgtaataagggagtgggtattagaataccttattcaatattgtccgatgcattatcatctttgggcagaatgatcggagacaattttctaaagatgttgataagaaaaagtacttaccaaaaattttccaaattttagtcatgcaacaccctcgatagtagatctaaaatgtcaagttcgaaaagactcattccgatttatatagattgatctttatataaagaagaacaatatatttactgtgctcaatcacgctcagacaaagagattgaaaccctcagtaaggccatagaaaaccatattgccttaattgtacagttatttgaattagcgtccctgcaaaactgcttttctacaaaaactcataacagatgggccaccgccttggagtatgttaaaggccttttaattaacccatcaaggtgtcatttatcagcaatttcggacaattgtagcattgtaaataatcaatccttcagtcattttctctctcaatctccttgggatcatcaaagactcatagattggatcatcacgaatgggtggcatctcattggaaaaaatggtgcattggccatcgatgaatgtgccaccccaaaggctggagatttttcggttggtgttaatcgccaatattgtgggaatttgggtaaggttgagaattgtcaggttgctgtctttatggcctatgtaaagaatggctttcgattgttacttgactaccgtctttaccttcctgaaagttggacatccgaccgtaaccgttgtgatgcagcgggcatacctccggaatttcaatgctttaaaactaaagcggagttagcatacgaactgatttgtcaagcgattgaagcaaagatcaagttttcttttgtggcaatggatggattttatggaaaacacccttggttacttaccagaattgagaacatagaagttacgtatgttgccaatattggttcgaaagaccgcgtaattattgagaaacctcagtattggattcctctcaaaaagggtattcgaggaagaaagacatcactcataaaaatccttaacacggttccagttcgtgtggaagagataaaaaaacaatagatcggtggagagtagtacgaattagagagtcgactgatggatttctcgaattaaattttgcagccatcagggtttggaggattgataaagatgtaaatgaaccgatccccgtttggctccttatacgtaaagatctcgatgattcaaatgtcaaatattcattatgcaacgcttcctctctctgtaccttgagtaaactagcaagaatgcagagtgagaggtattgattgaacgatcatttcaagatgcgattgatcttgctgggatggccgattatcaggtaagaaactgggatgcatggcatcatcacatggctctggtattattagcaatgctatggattacaaaagaacagaaacattttctcagcgttaagaagagcataacacctcatgatgctgtgaaaataatccagaccttgataccattaaagattaaaacttctttgaaaacggctaaaataattatccgaaatcataggaatagaaaaagttctcgcagatcgaaaatgaagaaaaagaacggacctctcatctgttagtacatcgaagccaggtgtgtgtgtgctgatcaaccaaacatagctcccggcttcgcaatattctctaattttctaatcatttagcacttctgatccatacttcttttgtaatatcggaaaattcggtaaataagattcattcaaattgaaagttacctctaaatttatctccttactcaaaaatcaacctactgccgcgagtgaacttgacattttagagttatttattgagcgccaaaatggaactgatagaaattggaattctagagaagtcagaaaaacactttgtttctctaaataacgagaagaacatgattcgatgacattttttcattgtatagctacaacttgtgctggcctattcggacacttcgaattcaagataactggagtgaagtatcttcacagagaacacctgctatggcagctggtctaattgatcatgtatggtcaataagagaatggattagctttccagttgtataatgttcttagatcaccaccattcatttcgaatttaacaaaaaggacaaattacagagagcctcttccggatgaaattaggaggtggttaaccagttattggtacgaagttaccaatgataattttttcgggatgcactccttccaaattcccagttgtttccaaaccttacctctcatcgcacgagataaaagaacatctctgctactcaccacctaccccgaccagaacatgccggtttcgggggccgtcaaactcgcaaaagtaaataccctgccaggtccccagagccaaccggccatctatcaccggtatcgtgagagaaaaacccatcagggaggccttgatatgggcatcggagttcccttctgcgtgacggtaatcaccgacaggcggaaccagccgggcaagaccggcaagtatgtcacgaacaacgtcaggatctgcattctcgttgatggtaagacctgctgtcgtgtgctgggtaaatacaaaacaggttccattctgcactccggttctccggacttcctctgaaattctatcggtaatatcaatgaactgtgttcttgaaccggtactgacgtcaatttttatccacttcacccatatcgcctcatctgtctttcagtgtctgtgatgtatacttccatcgtattatctgattcgatcaggaataagacagtatgtaattactcatcatcctgtcattttacaaaattttcaagagaaaagaaataatagcgtgtaattactcgaatagcgtgggttttcatgtttccatgatatcctcatcatccttatgactctgaattaacgtgcgataactacaaccaccaagggaagacattgacaaaattccaacccgaaacacccaatacgtattcagctgataaaaacccatcagtacatataatgattgagttaaataaaaaaatcaaatacattatctatgattaaagcaaacattatatctctcattttgactatgcaggaaaaaagaccaaacaaagttcttggatatcggaatgatattcatggagaaccaactcaaactctcatcggatcggacgataatgaaagatctattatattctgtctgaaatcaggagattcgaccatcatcacatcccgggatctgaatatcagcaataacccatttactccatgtgatgaatcagtacatcaaaaaatattcaggaatatgaaaaaacatccggatatctatgtgaaattttttactctcctaaacgaaaaaattccccggtgaattttattctgatctccttttttttcagataatcagaaatcaatgcaataatatcagtattcatgagacgataccgaatctcgcatatcgtcttggaatattctcaattgaatggagacgatttcattcctccttcgaatacaatacatattcatgaaaaaccgattttggataaataagagaatatccatgccttatctgaagaatgtacaaatttagatagagatctttctgaacaaataagcaccgatcaccgtcatagcacaggcaaatcctccgataacgataaaacacagaaccggatttatctgactgactcccgtaaggccataccggatcccctcaacaccgtacgtcaggggatcgcatgttgttattggtaaaagccagttgggtagagaactaattggaaacaaggccccggacagaccgaatatcggaaagatgacaaagttcatgataagctgaaaaccagtcatatcctccattctggaagctattgctatcccaaaggcggtaaatgagatcccgatgagcaccataaaccccagtgcgatgagaaaaccggagacactctgcacctgtaaccccagaaagagtgagatgaccatgatcataatcccctgaataaccgctgtcgttgcaccgccaaacgtctgcccaagcatgatctccatcctggttaccggggcgataagggtctctttaagaaaaccaaactgtttgtcccagatgatctgaatcccggaaaagaccgatgtgaagaggacactcatggcaaccataccggggatgagaaactggatataattctccccaaacccgggaatactcacaactgaattcaggccaaatccaaggaagagcaggaagaagaggggcatgctgatactcccgataatccggctttttgaccggatataccgtttcatgctccggagccagatagtatagatgatatccatattagtgcctcctcattttgaactgtcgtcgcatcatctctttcttgtcactctcctgctcccgtatcgtcttcccggtaaaggcgaggaacacatcctcaagcgttggtttgtgaaccgatacagagtgaatcgggatctgatgctgactgagaagagtgatgatatcgctgatatgctgctcggcattgtgcagatgtatccggacttcatcattatgcagttctacctgatctatccaggatccggtcaggacctgtgcgaccgtgtcataatcaggagtctgaatggtgataatatctccgccgattccatctttcaggttttgcggactatcaagtgcaatgatagtcccatgatcgatgattgcaatccggtcgcagagccggtctgcctcttccatataatgggtggtaagaatgatcgtgatgttcttttctttacttaatgtcgcgatatacttccagagatggttcctggtctggggatcgaggcccagcgttggttcatcaaggaagagaacagacggatgatggagcagaccccgggctatctcaagccttctccgcattccaccggagaatgtcttcacaagatcatccttccggtcatgaagttctaccagctggagcagttcatctatccgctgtctcctgatctcaggagggaggcgatagagccggccatggaaatccatgttctcccttgcggtgagttcctcatccaggctctgatcctgaaatactatcccgatggcttttctgacaccatcttcatccttttgaatatcccttccctgaacggctgcaaagccggatgtcggtttctgcatggttgaaagcatggagagcgtcgttgtttttcctgctccgttcggtccaagaaggccgaatatctctccctgcgttatctcgaaggagatatgatttaccgcagtaagatcagagaatgtttttgtcaggtcggttacctgaatggcaatggtcatgatatggtatcctgatgttaacagtttatagcaatatttcaggttttaagacttgattgattattcataatcaatacatagagatttaggcctctttcatcgaatttttaatcgtttcattaattcggttgattttcactccgattctctcaagtatccggacatatggggccagtttttcttctgcaaggtcctccaggtaggaaagattactgtctatctcggtcagaatactttcaattgaacctgctttatcccatccctctgctttaaacatgctgatctcttcaaatcctgcatctgtcagttcgtattttcgatctactctctttactatcagattatcatccacggccttactgaggagtgggtagattgaaccgggtgacggtttccagtgaccatgactcatcatgtctatcgtatccatgagttcagctccgttctttggcccttcacttaatatatagaggacgagtaatttgagccccccatatcccctgaagtgcccaagacggtgaaatttcctcatgaatgccctcatatcttcacgattgtctcgcatacgtgttaccagctcccggaataacagatatcggttagtcgatatcgacaatacgatatatgatgttacactataaaaatatatcgtattcagaaacaaagggagaaaaaaaagcggaaggagaaatgaaatctcttctttgattacaaaaaaaagaaacgaaattattaggttattgactgacaattacagccttcggtagtataccaacgatagaccatttcaaacccattgatgatctcatcagtcccttcaagtcccaccggaccgaaaaagataaccggcgtattcatcatgcttcgattgtgttgaatgtatagttcactcatcattacctccgattctggtccggctgaaagatttaccatttcaaccttaacaacaggatggtcggatatgtatttctcaagatattcatgaacaggaatgcagggaccacattcgggatcataaaagaaaactaccggtgctgaattatttgcaggctttgttgtgtttaccatttcatacagatcatcgatagtgagttctgatccatcttcagcaaaaatggttgcattcaccggcagtatcaatatactcattaccatgaacagaattgcaaatatcttttgattggggccgaaatatttcttcataaacaaatcacagtccctatgacatataaaaatagttatgtactgattccattattttccttctgtaaatatcctgaattgatcagtattcataaccgtgcaatccacatagatgttatggaagagaagatatttcatattatgagagagttgttatacctaatacagaggaaagcaggtaaaattttgaattagggtcagctcacacaaaaaacttacaatatgagcaattattaaattgtatccgggacctatacctcggtcggaaaaaagagacagatccagaaggatctcctgtaaaagctcacagatcctgcggagtgagaagagcggtgtcatcgaaccacatctccatgcactccttcagatggcaaaccaaaataatgaaacggtccgctggtgttcataccaacggagcaactggctgatccccggacatctgaaataccggtgatggcagagagatatcaagggcctcgtgtaacacctcatcaaccgtcccaaccaggataaaggtcagttcatccctcacatccgcaggaatatcagccagatcacgctcattctcctttggaagaataattctcgttatcccggcacgatgagcagcaagcaccttctcccgaatccctcctaccggtaagactgacccgctcaaagtcacctcaccggtcatggcaaggcgggaatccaccgtcttcccggtgaaaagagagacgagagcagtaaacagggtgacacccgccgaagggccgtctttcggagttgcaccggaggggacatgaatgtggacatcacttgccatgaaatcgatatggagaggactatgggcaaacctggagcggataaggctcatcgagatgtttgccgactctttcatcacatcccccagttgtccggtgagcgtaagttttccggtgccgggcatgaacgtcccttcaataaagaggatatctcccccgactggagtccaggcaagaccggttgcgactccaggagccagagccttctttgcaacctcatgccggtgcacctccttccccaggatcttcggaatctgatcagatgatatcacaaccggaggggtccatgtttcagagacaatcttctctgatacatacctggatatacggtctatctgttttttcagaccacggacacctgcttcatgggtatacttgtctatgaccaggcggagtgcatcatcatccaccgttaaaacctcggcgctgagcccgtgttcacccaaagatttcggaatgaggtgctcttttccgatggagaacatctccagttttgtataccccggaatctcaataagttccatccggtcaagaagcggaccgggtatggtagccagggtatttgccgttgctatgaagaatacgtcagataaatcatacgggacttcaagataatggtcggagaatgtactgttctgttcaggatctaaaacctcaagaagagcacttgccgggtctcctgagtatgaagatgacaatttatctatctcatcaaggacaaagactggatttttcgcccctgctctcctgataccctgaattatccgaccgggaagggcaccgacatacgttcgccgatgtccccggatctctgcctcatccttcacaccgcccaggcttattcggacatattttctaccaagagcatcggcaatactctttccaagacttgtcttgccggtccccggtggtcctgcgaggaggaggatggagccctgcttgtcatgcttgagtttcataactgcaaggtgctcaataatacggtctttgaccttttcgagtccgtaatggttcctctccaatatgcgcctggtttctctgatgtcaatacccgtgggttttgttgttacccagggaagatcgagcaggagatccaggtaatttcggataaccggactctcatgcccctgatttccgctggactcaagttttttcacttctgctagggcttttttctttacctcatcaggcattgatgactgcatgacccggtcacggtacccggcatcttccggtgaagagccattcagatctcccaattcttcctgcatcgcccgaatctgttcacgaagcatagcctcacgattacttcttgcagacttctctgataccttcttcgtcatctcaatccggagactgatattctccttgcaatcaataagaattccaaggaacatgagatacctggtacggagcgagtcagcctcaaggatcttttgcttcttttctaccgggactggtaagaatggcatgatgaaccccatgagctgatctatagactccatctgaccggccggtccgattatatggtccgaaccctggaagacatgcccaatatcaaagatcgtcttcttgatctcatcgagtagttccctctgcccctgttcatcaatatcctgaatgttcggaatcaccgtacaggtagcatacaaccggtcaccgttgggaatgaccgtatctatccgtacccggtcaagggcatgaaccccaaggaggtacccctcacctgttttatggataaatgagacttcaagaaggtttccaattgaatacagattttcttcagtgagattggaaggatcagtctcactatgcaccgacactccgatcagatgaacagtatcaggacggcttaactcattgataagtactgttccggtctcttcatccaccagaattttcgtcctcgtatgggggaaaattactgtgttgatgagagggaggagataattctcatgctgattttgtgaaattttagaatcttgtgtagtcatggttttgtttagtttgtttttgcctaactattcagtctgataaaaaaatttacctgacttttttcaggagtgtgataaggagctcaatctcctgatcatccagtgaagcaatgacccggtcaataaccttctgcagggctttttcttcagcacgggcaatcattgctcctttgtcggtaagccggatatactgaatcctcccgtcataaggacaggattcccggtacacacaatccatccggctcagtttatggatcatgccggtgatcgttggtttggagttttgtgtaatttcagcaagttctgaaaaggttacatccttatgttcgtcaatgagcttcagataggcgatctgctttatcgtgatatctgaaagacagcattcagagaagatcccacaggagcattcagctttcagcctgatcaggtgatcaaatatccggaagaggtgctcatgaggatcatccatagtgcagtaccagttagttaggttttaccaaactataaaatttgtgcactaccattctatcagacagcaatgaactccgctccctatgatcaacaaaccaaaactttttgattactctggacatttatccccctggtagagaattatgaaggtaggaataagtcgagtaaaattactcttcattctggttatcggatgcttgtgtgtaatcggatgttgtgcgcaaccaatggaagaacctcaaccaggtatgatgaatcccatacctggagaggagagaatagatccggaacttatgaacctccagatgatacccggacagataatcaatgaaaatcctgaaggaaagccacagggagagtttcaggagcagccccaggattccatgtatggcaaaggagggagcattctgggaggatctccgggaacatacatccttattaccggagtaaagggtacctgcaccgctgcgagtcataaaaactggaatgatgtcatgagttatgccttccatgctggtgagaaccctgaagatgaaaagatattcggggaggaacacctgacaataaccaaacaagtcgactcggcaactccagcgatcttcaacacattcaagagcggggggcagattagtaccgtttggatggaaattgccgggaccaataacattcttgcagcagtagtcatgaaaaatgcacggattaccgggtattcatccaccggtgatgcagctcagattccaatcgagactatcaccttcaccagtggcgatgtaacatggaatgttccccagataagcagtgaaggaattcaaaaataatattttattctaattttatcggaacatcgaagctggccgatccaagtggattcaccccatgcatcggtgcgttcgttttcaccggtcccggatcatcgatctgctgtccatcacccagccagtcaccgtcaatatcctcttctgccatggatgcccagggccactgggtacctgtgttgtcttcactcatcggatccgaatacagcagatggcaatgatactcaccttcttccagcgaaccatcgaatgcattacagacataacagctccaatatgaagccctgaaccgcctgccattatcaaatgaatacccggtaaacccaacattccatgatttacaccggttctcatccggatttgaaatctctcccctgataagatggatatacccgttatcatcaatgaccttactctggagcatcattctggccagttctgtctcccttccagcctccttgaacaacttttcctgcgttgagggatcagcaatatctttaaggtttaaggcaatctgatcaacagttgtcccaagatatctcctcttctcccggatggtaatcgtgaaaggaacaccggcagcattgatatagcttccctgcaggttacaatccgaatttctggtcaattcaatatacgggggccagtcgatccggtacttgtcagtattcccaaacaaccagtctccttccttcatactgccgttaagagcttttcccccatagacctgcccttgtgaatcagagtaggtatcacaggcttcagagtaactatccggtacatactccccgtactggtccatgacaccgcccatgggatctacatactgaccgtactgatcaaaaaatcctccgaaagtatcataatcccgtccggtcaccggatcataggatggagatgccccatataccggtaaaataagcagggatataatcagaatgaggatcacgacggatggaaaaatccaatatcttctcatgataatcatctgatactcgtaaggcttaggggaaaatatttgtcctatcctgatcggtatgagcatggagatgtaaatggaatatcggtacctcattcagggaataatcgcaacatgtgtcggaattcttctttggctgctgtctgatagcatatcattccttgcgccgtttcctctctatgcaggagtattactgacgatagaggctgttgcacaaacacaaaaaaagcttaatataaattattaaagcttaattatatatattattaagatcaatatattatatgtctcatcgctataacatgattagaggatatggtaatgaacaacaatttttactccctgtcaatgcgatggactggctatctgaaaatgatattacttatggcatattagaaattctttcgattctcgatattagtccatttattaataaatatcgtgacgatggtcgcggttctgccttttttgatcctcgttcaatgcttggaataataatttattcaatgattcgtggagaaaaatctagcagaaaaattgagatgtgctgccattatgatattggatatcggatcgtcgccaataatcttacacctgaccatacaacgatctatcgtttcaagaagaataattcaaaagaaatcaaatccctttttaaacaattatctcaaattatcgtagaatccgggatagcaagaatcggtgtcctagccctcgatggatcaaaatttggctgtaatgcctctttatcagccaataaaaaattaaaataccttgaagcagagctaggtcggctttttgatgaatcacaggaaattgatgagttagaaaacgatgatataaatattcaggatatggagattaaccgactacctgagcatctttcaacaaaagaaaaacgaaaggaagttcttaatcgggctaaagagaaattaattgaacgacatgatatcgaatctaaaaaacaagaagaaaagattctggaccgcgaaaaagaagaattagaatcgggtaaaaagaaacgaggtagaaagcctttagagcctaaaaaagagccatcttcagattcaaaagtaaatctcactgatcctgaaagtcagataatgtcaaccaccaatggctggattcaagggtataatgggcagattatcgtttctgaaaatcaatttatcctcgctgcaatgatatcagatgagcaaaacgataaaaaattattaatacctatgctaaatgaactcgaagacctttttacgggtattcatccatcaatttcgcctaatatactactatctgatgcaggttatttctcatacccgaattctttagcagaattggattatggcattcaactcatcatccctccttctaaagaaagaaaaattccagaatattcagataatgatgggtatatctcacgaatggaaatgatatgtcgggcgatttgtatgggagaaataatcacatttccggaattgcaaagtatcgggacgtttgtttggcaatcttttatgaacagagagaaacaagcaacaactcaggaaatttgtaaacgagttatggaagtacgtgtgaaatcccccactggtagagagttatatcgaaaacgaaaatacatggtcgaaccagtttttggtaatatgaaacataatatgaggtttaggagtttctctcaaaaagggaaagagaattgcgagggagaattctttttagctgcattagtgcataatataaaaaaacttatcagatttgagggtatagttaaaattaaagaatttgctacgaatattataaaaccgtcaagaggttcaggtttttcctatatttttgcaaacacagtatgtaaagtgggaattgatacatgcaggttcatacatcaattagtctattttggttgatagcttaaggggtagagatcgatcatttgtgatcctgcatgatattgatcattggtgcaacaccctcgatagccggcataattaccatcatagtcgggacggctgttcagttgctcaaaaaatagagacagggggttcttttcagacaggattcagacacgcacgaatcatcttttcgagatcatcgagatcatagaaaataatcgtctcatcctcctggtaggggacgcatgaacggccgataacacaatagatctcctttcgatatgaagtaccccattttacgagaacagctttctttttcaaactctggactattttttcaacatgaacattatcctgccatttacactcacagaagaggattgtatctgattttggatcaacggctacgagatcgatctcctgctccttataccaccatcgcccgatatctgaaaacctgactggaaaaagaccctgtgagttgaaaagataaaatacatccagaatgatctcctcaaatctgcgcccgatatactgtgataattgaggggcaatattctcacgatatacatattttgattcgcccatttctatctcttttcgatatgggtatacaaaccggaaccagaaagaaaacagattgtcgttaaggagataaaccccctttcgactcacagatccggacaatacgggagtttctcttcgtattaactgtaagtctgcaagggttgcaagatacttggaaaccaggcccttttcaagaccacaatcattggcaatgagccctattgtcgtattgccacttgctattgagaggaggattgaataataatatctgggctctttcagttccatacgaagaacaaactctacatcccgatagaggaatgcatcttccataagcaggttctcacatacgatctcttcaagatccaggaagggttcatcaatgagacaatacgcgggcgttcctccaaaaattgcatagagtattatcgcggttcgcagatcattcacatacggataaaaatcaatgaaccgaaatggtttgagtaatatctgcccggtccttctcccataaagcgggcttttgtactgcatgagttgagactcaacaagcccgatacttgaacctgataatatcagatagaggtgagtctttccaagagcggtatcccagtagtactgtagaagagaaggaagtgacgaatcctcctgaacaaggtatggaaattcatcaattgcaataacaacacgcttatcgccacgttttgtaagatatacaaaaaatgcatcccagtcaggaaatggtgcatggaggagataatcatcctgaaaaaaacctgccaattcggaggagatccgttttaactgcagatgttttgactcctccctggccaggagccgaattccccctacctgactgatgaactgatcagtaagttcgctctttccaacccgccgtcttccatacaagattacaagttctgccttctcactatgaaacctccggatgagagctgataattctgttttccgatctatgaacatactttaaagtagtctacttgaaagtataataatatcgatagttcctaaatcgcaataaaaaagattaaggttatgattcaactgtaaatgctattgctttcttgtataccgatgaaaccccgtcattgttaataacacagagatccagtttccctgatttgacttcatctgatagtggagcatcgatcttcacccggatctttatagtattgtgggtcaagaccggttttggctgatatgagaaccaggtcagactatcgccggcaagaaggacctcacatggctccatgaactcccttccggttatggtcacatcgctggctttgtcaggagtaaggaccggagcctctaccgatatgataacaggtggaatctgctttcccgtgatctcgaatggaacagttgcctttccggtcttcgtggtaatgacaaggttccaggttccctgctctgcatctgacggaatgtcaatcattacgacgccatacttctggttttcggtaaagcagtaattgtacgcctcaataccgacgttgtctttcaccagcgtgacatataccggggatgaaaaatgatcaccatagatcttaattcccatggtattgccagccccgccggaatatgggtagatgctggtgacatgaatcccccgctcattgacgatcttctcactcatgccggcaaaccggggatctgataccggttcttccggggtttgcttaggagggacctccggagtcggcgtgatttcaggggtgaggggaatatcaacggatgcattcaggtcatcttccgggaacggctttgacccgttcaggactgtaatattgaccacaccggttcgcatatcagaccctgcaccggccctgattgagtacacaccaggctgcacggtttcagggatggggaccattacggatctcctggtgcttctgaggataagaccaggaacctgtgaaccgacgccgattccaagcagttcagaatcagggattaccgtaaaatttatccgttcacctaagagtttgactgtatcaagggaccagagccgatcctgagtgttctttaaaactgcaccatctttcccggctatggtcattgccgagacatccaggttcagggtaaattcaacctcatcgccgggagccacctcatcagggaaggcagacagacttcccttaaggagcatggtgccgcttggtggagcagaatcaccggtccagttggtaaatccatgtccaaaattttcaaaaaatggcccgttgaagataatctgctcttcagagactgctgcatgggcagaagaggagaacagaatgaggaacagaatcgtcagaaaataccggtatactccatcgaatgcagatctctgtgcatgaatacccataattccatcgaacattaaaaaggagattgcaagttcctgaatttatttgttcctgaaaaaccggcatatgagtttggcactaatggcaggcaatagtgatcagcctgaatgaatacgcattttccagctacacgccggattttgattcatatttccgctcgtacaaatcgatggcctgcatcctgccatttgcatcgttcggactcatgacaatatcatctgctgaaagaccaaaataatcaagcgtttccctgataagcgggatatccataaacccctccatattgccggatgaaagcgacacgatgatctggtgtaatgacttttctaccatggagaatatcgtttcaccgtcgtcaccataggagatatcaacccctgattcctggagcaggtgaatcatcgcatccatatcgcgatctgccggagtcttgttgtccagagcagactgatctgccatccctggagaagaaggagtatcagcgggatcactgtcaagagcagataccggaacagcggatgcacaaagcagtatgatcaggatacgtatgataaatttcatgttttgctatatgagagggaacattttttacccaattttttagttaacctagtatattaattaataaataatcacgataagcaaaaaacctcttgataattttgggtctccaaactgtaaaccagggaattattttacaaacagaacagatcattcattatctcaagaacccaatacccattccggagaagagagatgaaaaaaacctataccctactgctgcccggaatccttatagcagccatatttctctgcggatgcagtgctctttttcaagagccgacagtaaccgttggatctgttgaccttgcata
